US007579148B2

(12) United States Patent
Wohlgemuth et al.

(10) Patent No.: US 7,579,148 B2
(45) Date of Patent: Aug. 25, 2009

(54) METHODS AND COMPOSITIONS FOR DIAGNOSING OR MONITORING AUTOIMMUNE AND CHRONIC INFLAMMATORY DISEASES

(75) Inventors: Jay Wohlgemuth, Menlo Park, CA (US); Kirk Fry, Palo Alto, CA (US); Robert Woodward, Pleasanton, CA (US); Ngoc Ly, San Bruno, CA (US)

(73) Assignee: Expression Diagnostics, Inc., South San Francisco, CA (US)

( * ) Notice: Subject to any disclaimer, the term of this patent is extended or adjusted under 35 U.S.C. 154(b) by 190 days.

(21) Appl. No.: 10/990,298

(22) Filed: Nov. 15, 2004

(65) Prior Publication Data
US 2007/0037167 A1 Feb. 15, 2007

Related U.S. Application Data

(60) Division of application No. 10/131,827, filed on Apr. 24, 2002, now Pat. No. 6,905,827, which is a continuation-in-part of application No. 10/006,290, filed on Oct. 22, 2001, now abandoned.

(60) Provisional application No. 60/296,764, filed on Jun. 8, 2001.

(51) Int. Cl.
C12Q 1/68 (2006.01)
(52) U.S. Cl. .......................................................... 435/6
(58) Field of Classification Search ........................ None
See application file for complete search history.

(56) References Cited

U.S. PATENT DOCUMENTS

| 4,190,535 A | 2/1980 | Luderer et al. |
| 4,215,051 A | 7/1980 | Schroeder et al. |
| 4,350,593 A | 9/1982 | Kessler |
| 4,358,535 A | 11/1982 | Falkow et al. |
| 4,376,110 A | 3/1983 | David et al. |
| 4,582,789 A | 4/1986 | Sheldon, III et al. |
| 4,683,195 A | 7/1987 | Mullis et al. |
| 4,683,202 A | 7/1987 | Mullis |
| 4,751,001 A | 6/1988 | Saunders |
| 4,762,780 A | 8/1988 | Spector et al. |
| 4,789,630 A | 12/1988 | Bloch et al. |
| 4,800,159 A | 1/1989 | Mullis et al. |
| 4,818,418 A | 4/1989 | Saunders |
| 4,843,155 A | 6/1989 | Chomczynski |
| 4,889,818 A | 12/1989 | Gelfand et al. |
| 4,908,318 A | 3/1990 | Lerner |
| 4,946,778 A | 8/1990 | Ladner et al. |
| 4,946,952 A | 8/1990 | Kiefer |
| 4,965,188 A | 10/1990 | Mullis et al. |
| 5,053,134 A | 10/1991 | Luderer et al. |
| 5,063,162 A | 11/1991 | Kiefer |
| 5,066,584 A | 11/1991 | Gyllensten et al. |
| 5,075,216 A | 12/1991 | Innis et al. |
| 5,079,352 A | 1/1992 | Gelfand et al. |
| 5,091,310 A | 2/1992 | Innis |
| 5,120,525 A | 6/1992 | Goldenberg |
| 5,142,033 A | 8/1992 | Innis |
| 5,143,854 A | 9/1992 | Pirrung et al. |
| 5,210,015 A | 5/1993 | Gelfand et al. |
| 5,212,071 A | 5/1993 | Fearon et al. |
| 5,215,882 A | 6/1993 | Bahl et al. |
| 5,219,727 A | 6/1993 | Wang et al. |
| 5,264,351 A | 11/1993 | Harley |
| 5,278,043 A | 1/1994 | Bannwarth et al. |
| 5,310,652 A | 5/1994 | Gelfand et al. |
| 5,314,809 A | 5/1994 | Erlich et al. |
| 5,322,770 A | 6/1994 | Gelfand |
| 5,340,720 A | 8/1994 | Stetler |
| 5,346,994 A | 9/1994 | Chomczynski |
| 5,352,600 A | 10/1994 | Gelfand et al. |
| 5,374,553 A | 12/1994 | Gelfand et al. |
| 5,385,824 A | 1/1995 | Hoet et al. |
| 5,389,512 A | 2/1995 | Sninsky et al. |
| 5,393,672 A | 2/1995 | Van Ness et al. |
| 5,405,774 A | 4/1995 | Abramson et al. |
| 5,407,800 A | 4/1995 | Gelfand et al. |
| 5,411,876 A | 5/1995 | Bloch et al. |
| 5,418,149 A | 5/1995 | Gelfand et al. |
| 5,420,029 A | 5/1995 | Gelfand et al. |
| 5,426,039 A | 6/1995 | Wallace et al. |
| 5,445,940 A | 8/1995 | Brenner et al. |
| 5,455,170 A | 10/1995 | Abramson et al. |
| 5,459,037 A | 10/1995 | Sutcliffe et al. |
| 5,466,591 A | 11/1995 | Abramson et al. |
| 5,468,613 A | 11/1995 | Erlich et al. |
| 5,476,774 A | 12/1995 | Wang et al. |
| 5,487,970 A | 1/1996 | Rowley et al. |
| 5,487,972 A | 1/1996 | Gelfand et al. |
| 5,491,063 A | 2/1996 | Fisher et al. |
| 5,491,086 A | 2/1996 | Gelfand et al. |

(Continued)

FOREIGN PATENT DOCUMENTS

EP 0 217 102 A2 4/1987

(Continued)

OTHER PUBLICATIONS

Abdallah, A. N. et al. (1997) "Evaluation of plasma levels of tumour necrosis factor alpha and interleukin-6 as rejection markers in a cohort of 142 heart-grafted patients followed by endomyocardial biopsy" *European Heart Journal* 18: 1024-1029.

(Continued)

Primary Examiner—James Martinell
(74) Attorney, Agent, or Firm—Morrison & Foerster LLP

(57) ABSTRACT

Methods of diagnosing or monitoring an autoimmune or chronic inflammatory disease, particularly SLE in a patient by detecting the expression level of one or more genes or surrogates derived therefrom in the patient are described. Diagnostic oligonucleotides for diagnosing or monitoring chronic inflammatory disease, particularly SLE infection and kits or systems containing the same are also described.

8 Claims, 12 Drawing Sheets

U.S. PATENT DOCUMENTS

| | | | |
|---|---|---|---|
| 5,501,963 | A | 3/1996 | Burckhardt |
| 5,506,145 | A | 4/1996 | Bull et al. |
| 5,512,462 | A | 4/1996 | Cheng |
| 5,514,556 | A | 5/1996 | Shearer et al. |
| 5,538,848 | A | 7/1996 | Livak et al. |
| 5,561,058 | A | 10/1996 | Gelfand et al. |
| 5,565,339 | A | 10/1996 | Bloch et al. |
| 5,569,583 | A | 10/1996 | Greenberg et al. |
| 5,571,673 | A | 11/1996 | Picone |
| 5,573,906 | A | 11/1996 | Bannworth et al. |
| 5,604,099 | A | 2/1997 | Erlich et al. |
| 5,618,703 | A | 4/1997 | Gelfand et al. |
| 5,618,711 | A | 4/1997 | Gelfand et al. |
| 5,624,833 | A | 4/1997 | Gelfand et al. |
| 5,635,365 | A | 6/1997 | Ansari et al. |
| 5,641,864 | A | 6/1997 | Gelfand |
| 5,658,744 | A | 8/1997 | Ochoa et al. |
| 5,665,551 | A | 9/1997 | Gelfand et al. |
| 5,674,738 | A | 10/1997 | Abramson et al. |
| 5,677,152 | A | 10/1997 | Birch et al. |
| 5,693,517 | A | 12/1997 | Gelfand et al. |
| 5,707,807 | A | 1/1998 | Kato |
| 5,716,787 | A | 2/1998 | Dunn et al. |
| 5,721,351 | A | 2/1998 | Levinson |
| 5,728,822 | A | 3/1998 | Macfarlane |
| 5,766,585 | A | 6/1998 | Evans et al. |
| 5,773,258 | A | 6/1998 | Birch et al. |
| 5,789,224 | A | 8/1998 | Gelfand et al. |
| 5,795,762 | A | 8/1998 | Abramson et al. |
| 5,804,375 | A | 9/1998 | Gelfand et al. |
| 5,807,522 | A | 9/1998 | Brown et al. |
| 5,811,284 | A | 9/1998 | Chang et al. |
| 5,837,832 | A | 11/1998 | Chee et al. |
| 5,939,270 | A | 8/1999 | Haunsø et al. |
| 5,939,292 | A | 8/1999 | Gelfand et al. |
| 5,958,342 | A | 9/1999 | Gamble et al. |
| 5,958,688 | A | 9/1999 | Eberwine et al. |
| 5,965,366 | A | 10/1999 | Ochoa et al. |
| 5,968,799 | A | 10/1999 | Gelfand et al. |
| 5,973,137 | A | 10/1999 | Heath |
| 5,981,481 | A | 11/1999 | Fearon et al. |
| 5,994,056 | A | 11/1999 | Higuchi |
| 5,994,076 | A | 11/1999 | Chenchik et al. |
| 6,001,611 | A | 12/1999 | Will |
| 6,004,755 | A | 12/1999 | Wang |
| 6,010,853 | A | 1/2000 | Kanteti et al. |
| 6,020,186 | A | 2/2000 | Henco et al. |
| 6,033,860 | A | 3/2000 | Lockhart et al. |
| 6,040,138 | A | 3/2000 | Lockhart et al. |
| 6,040,166 | A | 3/2000 | Erlich et al. |
| 6,045,996 | A | 4/2000 | Cronin et al. |
| 6,048,695 | A | 4/2000 | Bradley et al. |
| 6,048,709 | A | 4/2000 | Falb |
| 6,060,240 | A | 5/2000 | Kamb et al. |
| 6,066,322 | A | 5/2000 | Levinson |
| 6,066,498 | A | 5/2000 | Levinson |
| 6,084,083 | A | 7/2000 | Levinson |
| 6,087,112 | A | 7/2000 | Dale |
| 6,087,477 | A | 7/2000 | Falb et al. |
| 6,090,556 | A | 7/2000 | Kato |
| 6,099,823 | A | 8/2000 | Falb |
| 6,124,433 | A | 9/2000 | Falb et al. |
| 6,127,155 | A | 10/2000 | Gelfand et al. |
| 6,132,997 | A | 10/2000 | Shannon |
| 6,146,828 | A | 11/2000 | Lapidus et al. |
| 6,150,121 | A | 11/2000 | Hamawy et al. |
| 6,156,887 | A | 12/2000 | Levinson |
| 6,162,604 | A | 12/2000 | Jacob |
| 6,168,933 | B1 | 1/2001 | Kaser et al. |
| 6,171,785 | B1 | 1/2001 | Higuchi |
| 6,177,254 | B1 | 1/2001 | Rattner et al. |
| 6,187,534 | B1 | 2/2001 | Strom et al. |
| 6,190,857 | B1 | 2/2001 | Ralph et al. |
| 6,190,872 | B1 | 2/2001 | Slotman |
| 6,194,158 | B1 | 2/2001 | Kroes et al. |
| 6,197,563 | B1 | 3/2001 | Erlich et al. |
| 6,203,987 | B1 | 3/2001 | Friend et al. |
| 6,204,371 | B1 | 3/2001 | Levinson |
| 6,214,979 | B1 | 4/2001 | Gelfand et al. |
| 6,218,122 | B1 | 4/2001 | Friend et al. |
| 6,222,093 | B1 | 4/2001 | Marton et al. |
| 6,225,084 | B1 | 5/2001 | Falb et al. |
| 6,225,093 | B1 | 5/2001 | Grant et al. |
| 6,228,628 | B1 | 5/2001 | Gelfand et al. |
| 6,242,185 | B1 | 6/2001 | Kaser et al. |
| 6,245,334 | B1 | 6/2001 | Seilhammer et al. |
| 6,245,526 | B1 | 6/2001 | Yue et al. |
| 6,245,527 | B1 | 6/2001 | Busfield et al. |
| 6,248,527 | B1 | 6/2001 | Chen et al. |
| 6,248,528 | B1 | 6/2001 | Chen et al. |
| 6,251,597 | B1 | 6/2001 | Shyjan |
| 6,262,244 | B1 | 7/2001 | Houchins et al. |
| 6,274,312 | B1 | 8/2001 | Gish et al. |
| 6,280,941 | B1 | 8/2001 | Tsao et al. |
| 6,303,321 | B1 | 10/2001 | Tracey et al. |
| 6,306,602 | B1 | 10/2001 | Sillekens et al. |
| 6,365,352 | B1 | 4/2002 | Yerramilli et al. |
| 6,403,304 | B1 | 6/2002 | Stashenko et al. |
| 6,410,319 | B1 | 6/2002 | Raubitschek et al. |
| 6,811,973 | B1 | 11/2004 | Reich |
| 6,905,827 | B2 | 6/2005 | Wohlgemuth et al. |
| 6,964,850 | B2 | 11/2005 | Bevilacqua et al. |
| 7,026,121 | B1 | 4/2006 | Wohlgemuth et al. |
| 7,235,358 | B2 | 6/2007 | Wohlgemuth et al. |
| 2001/0021700 | A1 | 9/2001 | Moore et al. |
| 2002/0042386 | A1 | 4/2002 | Rosen et al. |
| 2002/0128436 | A1 | 9/2002 | Strom et al. |
| 2002/0132235 | A1 | 9/2002 | Avihingsanon et al. |
| 2004/0033498 | A1 | 2/2004 | Behrens et al. |
| 2004/0072181 | A1 | 4/2004 | Whitehead et al. |
| 2006/0051803 | A1 | 3/2006 | Wohlgemuth et al. |
| 2006/0088836 | A1 | 4/2006 | Wohlgemuth et al. |
| 2006/0263813 | A1 | 11/2006 | Rosenberg et al. |
| 2007/0037144 | A1 | 2/2007 | Wohlgemuth et al. |
| 2007/0037166 | A1 | 2/2007 | Wohlgemuth et al. |
| 2007/0248978 | A1 | 10/2007 | Lal et al. |
| 2008/0038746 | A1 | 2/2008 | Rosenberg et al. |

FOREIGN PATENT DOCUMENTS

| | | | |
|---|---|---|---|
| EP | 0 217 992 | A2 | 4/1987 |
| EP | 1 077 254 | A2 | 2/2001 |
| EP | 1 162 276 | A2 | 12/2001 |
| WO | WO 91/18626 | | 12/1991 |
| WO | WO-94/23023 | A1 | 10/1994 |
| WO | WO 95/17506 | | 6/1995 |
| WO | WO 96/39536 | | 12/1996 |
| WO | WO-97/16568 | A1 | 5/1997 |
| WO | WO 97/30065 | | 8/1997 |
| WO | WO 98/24935 | | 6/1998 |
| WO | WO-99/04251 | A1 | 1/1999 |
| WO | WO 99/10536 | | 3/1999 |
| WO | WO 99/11782 | | 3/1999 |
| WO | WO-99/11822 | A1 | 3/1999 |
| WO | WO 99/15700 | | 4/1999 |
| WO | WO 99/52541 | | 10/1999 |
| WO | WO 99/57130 | | 11/1999 |
| WO | WO 00/04191 | | 1/2000 |
| WO | WO 00/12753 | | 3/2000 |
| WO | WO 00/23573 | A3 | 4/2000 |
| WO | WO 00/46372 | | 8/2000 |
| WO | WO 00/52209 | | 9/2000 |
| WO | WO 00/55375 | | 9/2000 |
| WO | WO-00/58473 | A2 | 10/2000 |

| | | |
|---|---|---|
| WO | WO 00/63372 | 10/2000 |
| WO | WO 00/73498 | 12/2000 |
| WO | WO 00/78808 | 12/2000 |
| WO | WO 01/20004 | 3/2001 |
| WO | WO 01/23426 | 4/2001 |
| WO | WO 01/23564 | 4/2001 |
| WO | WO 01/25473 A1 | 4/2001 |
| WO | WO 01/29269 | 4/2001 |
| WO | WO 01/32927 | 5/2001 |
| WO | WO 01/40302 A2 | 6/2001 |
| WO | WO 01/47944 A2 | 7/2001 |
| WO | WO 01/54733 A1 | 8/2001 |
| WO | WO 01/55164 A1 | 8/2001 |
| WO | WO 01/55201 A1 | 8/2001 |
| WO | WO 01/55203 A1 | 8/2001 |
| WO | WO 01/55205 A1 | 8/2001 |
| WO | WO 01/55328 A2 | 8/2001 |
| WO | WO 01/55368 A1 | 8/2001 |
| WO | WO-01/57182 A2 | 8/2001 |
| WO | WO 01/60860 A3 | 8/2001 |
| WO | WO 01/71005 A2 | 9/2001 |
| WO | WO 01/81916 | 11/2001 |
| WO | WO 01/86003 A2 | 11/2001 |
| WO | WO 02/00677 A1 | 1/2002 |
| WO | WO 02/00928 A2 | 1/2002 |
| WO | WO 02/28999 A2 | 4/2002 |
| WO | WO-02/057414 A2 | 7/2002 |
| WO | WO-03/090694 A2 | 11/2003 |
| WO | WO-2004/042346 A2 | 5/2004 |

OTHER PUBLICATIONS

Ajjan, R. A. et al. (1996) "Intrathyroidal cytokine gene expression in Hashimoto's thyroiditis" *Clin. Exp. Immunol.* 105: 523-528.

Akalin, Enver et al. (2001) "Gene Expression Analysis in Human Renal Allograft Biopsy Samples Using High-Density Oligoarray Technology" *Transplantation* 72 (5): 948-953.

Alizadeh, A. A. et al. "Distinct types of diffuse large B-cell lymphoma identified by gene expression profiling" *Nature* 403 (2000): 503-11.

Alizadeh, A. et al. "Probing Lymphocyte Biology by Genomic-Scale Gene Expression Analysis" *J. Clin. Immun.* 18 (1998): 373-379.

Alizadeh, A. et al. "The Lymphochip: A Specialized cDNA Microarray for the Genomic-scale Analysis of Gene Expression in Normal and Malignant Lymphocytes" *Cold Spring Harbor Symposia on Quantitative Biology* 54, (New York: Cold Spring Harbor Laboratory Press) (1999): 71-78.

Alpert, Susan et al. (1995) "The Relationship of Granzyme A and Perforin Expression to Cardiac Allograft Rejection and Dysfunction" *Transplantation* 60 (12): 1478-1485.

Arnett, F. C. et al. "The American Rheumatism Association 1987 revised criteria for the classification of rheumatoid arthritis" *Arthritis Rheum* 31 (1988): 315-24.

Autieri MV, Kelemen S, Thomas BA, Feller ED, Goldman BI, Eisen HJ. (2002) "Allograft inflammatory factor-1 expression correlates with cardiac rejection and development of cardiac allograft vasculopathy" *Circulation* 106(17):2218-23.

Baechler, Emily C. et al. (2003) "Interferon-inducible gene expression signature in peripheral blood cells of patients with severe lupus" *Proc. Natl. Acad. Sci. USA* 100 (5): 2610-2615.

Bave, U. (2000) "The combination of apoptotic U937 cells and lupus IgG is a potent IFN-alpha inducer" *J. Immunol.* 165: 3519-3526.

Bave, U. (2001) "Activation of natural interferon-alpha producing cells by apoptotic U937 cells combined with lupus IgG and its regulation by cytokines" *J. Autoimmun.* 17: 71-80.

Bittner, M. et al. (2000) "Molecular classification of cutaneous malignant melanoma by gene expression profiling" *Nature* 406: 536-540.

Bombardier, C. et al. and the Committee on Prognosis Studies in SLE. "Derivation of the SLEDAI, A Disease Activity Index for Lupus Patients" *Arthritis Rheum.* 35 (1992): 630-640.

Chang, D. M. et al. (1996) "Cytokines and Cell Surface Markers in Prediction of Cardiac Allograft Rejection" *Immunological Investigations* 25 (1&2): 13-21.

Chebath et al. (1987) "Four Different Forms of Interferon-induced 2', 5'-Oligo(A) Synthetase Identified by Immunoblotting in Human Cells," *J. Biol. Chem.* 262, 3852-2857, p. 3856.

Creemers P, Brink J, Wainwright H, Moore K, Shephard E, Kahn D. (2002) "Evaluation of peripheral blood CD4 and CD8 lymphocyte subsets, CD69 expression and histologic rejection grade as diagnostic markers for the presence of cardiac allograft rejection" *Transpl Immunol.* 10(4):285-92.

Damas, J. K. et al. "Enhanced gene expression of chemokines and their corresponding receptors in mononuclear blood cells in chronic heart failure—modulatory effect of intravenous immunoglobin" *J. Am. Coll. Cardiol.* 38 (2001): 187-93.

Database Gen Embl, US National Library of Medicine (Bathesda, MD, USA), No. AL 591031, 'Human DNA sequence from clone RP11-151d14 on chromosome 9q13-21.2, complete sequence', Sycamore, N., Oct. 10, 2001.

Davas, E.M. et al. (1999) "Serum IL-6, TNFalpha, p55 srTNFalpha, p75srTNFalpha, srIL-2alpha levels and disease activity in systemic lupus erythematosus" *Clin Rheumatol* 18 (1):17-22.

Deng, Mario C. et al. (1995) "The Relation of Interleukin-6, Tumor Necrosis factor-α, IL-2, and IL-2 Receptor Levels to Cellular Rejection, Allograft Dysfunction, and Clinical Events Early After Cardiac Transplantation" *Transplantation* 60 (10): 1118-1124.

Doi, S. et al. (1994) "Polymerase chain reaction quantification of cytokine messenger RNA expression in peripheral blood monoculear cells of patients with acute exacerbations of asthma: effect of glucocorticoid therapy" *Clinical and Experimental Allergy* 24: 854-867.

Dugré, Francine J. (2000) "Cytokine and Cytotoxic Molecule Gene Expression Determined in Peripheral Blood Mononuclear Cells in the Diagnosis of Acute Renal Rejection" *Transplantation* 70 (7): 1074-1080.

Edman, C. F. et al. "Electric field directed nucleic acid hybridization on microchips" *Nucleic Acids Res.* 25 (1997): 4907-14.

Eisen, Michael B. et al. (1998) "Cluster analysis and display of genome-wide expression patterns" *Proc. Natl. Acad. Sci. USA* 95: 14863-14868.

Felson, D. T. et al. "American College of Rheumatology. Preliminary definition of improvement in rheumatoid arthritis" *Arthritis Rheum.* 38 (1995): 727-35.

Fu, Guoliang et al. (2002) "Representational difference analysis in a lupus-prone mouse strain results in the identification of an unstable region of the genome on chromosome 11" *Nucleic Acids Research* 30 (6): 1394-1400.

Gabay C. et al. (1997) "Circulating levels of tumor necrosis factor soluble receptors in systemic lupus erythematosus are significantly higher than in other rheumatic diseases and correlate with disease activity" *J Rheumatol* 24(2): 303-8.

Ghosh et al. (2001) "A Specific Isozyme of 2'-5' Oligoadenylate Synthetase Is a Dual Function Proapoptotic Protein of the Bcl-2 Family," *J. Biol. Chem.* 276:27, 25477-25455, p. 25477.

Golub, T. R. et al. "Molecular Classification of Cancer: Class Discovery and Class Prediction by Gene Expression Monitoring" *Science* 286 (1999): 531-7.

Grant, Simon C. D. et al. (1996) "Serum Cytokines in Human Heart Transplant Recipients" *Transplantation* 62 (4): 480-491.

Gullestad, L. et al. "Effect of High- Versus Low-Dose Angiotensin Converting Enzyme Inhibition on Cytokine Levels in Chronic Heart Failure" *J. Am. Coll. Cardiol.* 34 (1999): 2061-7.

Hastie, T. et al. "'Gene shaving' as a method for identifying distinct sets of genes with similar expression patterns" *Genome Biol.* 1 (2000): Research0003.

Hastie, Trevor et al. (2001) "Supervised harvesting of expression trees" *Genome Biology* 2 (1): http://genomebiology.com/2001/2/1/research/0003 (Apr. 25, 2002): 12 pages.

Heller, R. A. et al. "Discovery and analysis of inflammatory disease-related genes using cDNA microarrays" *Proc. Natl. Acad. Sci. U.S.A.* 94 (1997): 2150-2155.

Hendricks, DA et al. (1995) "Quantitation of HBV DNA in human serum using a branched DNA (bDNA) signal amplification assay" *Am J Clin Pathol* 104 (5): 537-46.

Hooks, J.J. (1979) "Immune interferon in the circulation of patients with autoimmune disease" *N. Engl. J. Med.* 301: 5-8.

Hooks, J.J. et al. (1982) "Multiple interferons in the circulation of patients with systemic lupus erythematosus and vasculitis" *Arthritis Rheum.* 25: 396-400.

Hsieh, Hsian-Guey et al. (2001) "IL-17 expression as a possible predictive parameter for subclinical renal allograft rejection" *Tranpl Int* 14: 287-298.

Iida, K. et al. (1982) "Complement receptor (CR1) deficiency in erythrocytes from patients with systemic lupus erythematosus" *J. Exp. Med.* 155: 1427-1438.

Jagota, Arun (2000) *Data Analysis and Classification for Bioinformatics*. Bioinformatics By The Bay Press: 92-93.

Kasprzycka, Monika et al. (2002) "Expression of FasL gene in T cells of renal allograft recipients" *Immunol. Lett.* 80 (1): 9-13.

Katz, Mitchell H (1999) *Multivariable Analysis: A Practical Guide for Clinicians*. Cambridge University Press: 36-42.

Khan, J. et al. "Classification and diagnostic prediction of cancers using gene expression profiling and artificial neural networks" *Nat. Med.* 7 (2001): 673-9.

Kimball, P. et al. (1995) "Cytokine Panel Predicts Early Rejection of Therapeutic Response After Cardiac Transplantation" *Transplantation Proceedings* 27 (1): 1286-1287.

Kobashigawa, J. et al. (1998) "A Randomized Active-Controlled Trial of Mycophenolate Mofetil in Heart Transplant Recipients" *Transplantation* 66 (4): 507-515.

Kumar et al. (1994) "Cell Cycle-dependent Modulation of α-Interferon-inducible Gene Expression and Activation of Signaling Components in Daudi Cells," J. Biol. Chem. 269, No. 41, 25437-25441, p. 25438.

Kumar et al. (2000) "Expansion and Molecular Evolution of the Interferon-Induced 2'-5' Oligoadenylate Synthetase Gene Family," Mol. Biol. Evol. 17, 738-750, p. 738.

Legros-Maida, Sabine et al. (1994) "Granzyme B and perforin can be used as predictive markers of acute rejection in heart transplantation" *Eur. J. Immunol.* 24: 229-233.

Li, B. et al. "Noninvasive diagnosis of renal-allograft rejection by measurement of messenger RNA for perforin and granzyme B in urine" N. Engl. J. Med. 344 (2001): 947-954.

Liossis, S.N. (2001) "B-cell kinase lyn deficiency in patients with systemic lupus erythematosus" *J Investig Med*. 49 (2): 157-65.

Loftus. B.J. et al. Genome Duplications and Other Features in 12 Mb of DNA sequence from Human Chromosome 16p and 16q Genomics. vol. 60, pp. 295-308 Jul. 1999.

Magnusson, M. et al. (2001) "Importance of CpG dinucleotides in activation of natural IFN-alpha-producing cells by a lupus-related oligodeoxynucleotide" *Scand. J. Immunol.* 54: 543-550.

Marcelin, Anne-Genevieve et al. (2001) "Effects of Cyclosporine and Hydrocortisone on Kaposi's Sarcoma-Associated Herpesvirus Genome Replication and Cell Apoptosis Induction" *Transplantation* 72 (10): 1700-1708.

Melter, Michael et al. (2001) "Expression of the Chemokine Receptor CXCR3 and Its Ligand IP-10 During Human Cardiac Allograft Rejection" *Circulation* 104: 2558-2564.

Mohler, E. R. 3rd et al. "Role of Cytokines in the Mechanism of Action of Amlodipine: The Praise Heart Failure Trial" *J. Am. Coll. Cardiol.* 30 (1997): 35-41.

Morita, Ken et al. (2001) "Early Chemokine Cascades in Murine Cardiac Grafts Regulate T Cell Recruitment and Progression of Acute Allograft Rejection" *J. Immunol.* 167: 2979-2984.

Nickel, Peter et al. (2001) "Cytotoxic Effector Molecule Gene Expression in Acute Renal Allograft Rejection" *Transplantation* 72 (6): 1158-1161.

Oh, Se-Il et al. (2001) "Correlation of Fas and Fas Ligand Expression with Rejection Status of Transplanted Heart in Human" *Transplantation* 71 (7): 906-909.

Perou, C. M. et al. "Molecular portraits of human breast tumours" *Nature* 406 (2000): 747-52.

Preble, O.T. (1982) "Systemic lupus erythematosus: presence in human serum of an unusual acid-labile leukocyte interferon" *Science* 216: 429-431.

Pruitt, K. D. et al. "Introducing RefSeq and LocusLink: curated human genome resources at the NCBI" *Trends Genet.* 16 (2000): 44-47.

Raychaudhuri, S. et al. "Basic microarray analysis: grouping and feature reduction" *Trends Biotechnol.* 19 (2001): 189-193.

Rus, V et al. (2002) "Expression of cytokine- and chemokine-related genes in peripheral blood mononuclear cells from lupus patients by cDNA array" *Clin Immunol* 102 (3): 283-90.

Saiura, Akio et al. (2001) "A Comparison of Gene Expression in Murine Cardiac Allografts and Isografts by Means DNA Microarray Analysis" *Transplantation* 72 (2): 320-329.

Salmon, J. E. et al. (1996) "Fc-gamma-RIIA alleles are heritable risk factors for lupus nephritis in African Americans" *J. Clin. Invest.* 97: 1348-1354.

Schena, Mark et al. (1995) "Quantitative Monitoring of Gene Expression Patterns with a Complementary DNA Microarray" *Science* 270: 467-470.

Schena, Mark et al. (1996) "Parallel human genome analysis: Microarray-based expression monitoring of 1000 genes" *Proc. Natl. Acad. Sci. USA* 93: 10614-10619.

Schowengerdt et al (2000) "Increased expression of the lymphocyte early activation marker CD69 in peripheral blood correlates with histologic evidence of cardiac allograft rejection." *Transplantation* 69(10):2102-7.

Sharma, Vijay K. et al. (1996) "Molecular Executors of Cell Death-Differential Intrarenal Expression of Fas Ligand, Fas, Granzyme B, and Perforin During Acute and/or Chronic Rejection of Human Renal Allografts" *Transplantation* 62 (12): 1860-1866.

Shi, S.N. (1987) "Serum interferon in systemic lupus erythematosus" *Br. J. Dermatol.* 117:155-159.

Shirali, G. S. et al. "Association of viral genome with graft loss in children after cardiac transplantation" *N. Engl. J. Med.* 344 (2001): 1498-503.

Shoker, Ahmed et al. (2000) "Heightened CD40 Ligand Gene Expression in Peripheral CD4+ Cells from Patients with Kidney Allograft Rejection" *Transplantation* 70 (3): 497-505.

Shulzhenko, Natalia et al. (2001) "Intragraft Activation of Genes Encoding Cytotoxic T Lymphocyte Effector Molecules Precedes the Histological Evidence of Rejection in Human Cardiac Transplantation" *Transplantation* 72 (10): 1705-1708.

Shulzhenko, Natalia et al. (2001) "Monitoring of Intragraft and Peripheral Blood TIRC7 Expression as a Diagnostic Tool for Acute Cardiac Rejection in Humans" *Human Immunology* 62: 342-347.

Staudt, L. M. and P. O. Brown. "Genomic Views of the Immune System" *Annu. Rev. Immunol.* 18 (2000): 829-859.

Strehlau, Jurgen et al. (1997) "Quantitative detection of immune activation transcripts as a diagnostic tool in kidney transplantation" *Proc. Natl. Acad. Sci. USA* 94: 695-700.

Tan, E. M. et al. "The 1982 revised criteria for the classification of systemic lupus erythematosus" *Arthritis Rheum*. 25 (1982): 1271-7.

Tan, LamChin et al. "Sequential Monitoring of Peripheral T-Lymphocyte Cytokine Gene Expression in the Early Post Renal Allograft Period" *Transplantation* 71 (2001): 751-759.

Toogood, Giles J. et al. (1996) "The Immune Response Following Small Bowel Transplantation" *Transplantation* 62 (6): 851-855.

Törönen, Petri et al. (1999) "Analysis of gene expression data using self-organizing maps" *FEBS Letters* 451: 142-146.

Torre-Amione, G. et al. "Proinflammatory cytokine levels in patients with depressed left ventricular ejection fraction: a report from the Studies of Left Ventricular Dysfunction (SOLVD)" *J. Am. Coll. Cardiol.* 27 (1996): 1201-6.

Tsutamoto, T. et al. "Angiotensin II type 1 receptor antagonist decreases plasma levels of tumor necrosis factor alpha, interleukin-6 and soluble adhesion molecules in patients with chronic heart failure" *J. Am. Coll. Cardio.* 35 (2000): 714-21.

Tusher, Virginia Goss et al. (2001) "Significance analysis of microarrays applied to the ionizing radiation response" *PNAS* 98 (9) 5116-5121.

Umek, R. M. et al. "Electronic detection of nucleic acids: a versatile platform for molecular diagnostics" *J. Mol. Diagn.* 3 (2001): 74-84.

Vallin, H. (1999) "Anti-double-stranded DNA antibodies and immunostimulatory plasmid DNA in combination mimic the endogenous IFN-alpha inducer in systemic lupus erythematosus" *J. Immunol.* 163: 6306-6313.

Vandevyver, Caroline et al. (1998) "Cytokine mRNA Profile of Myelin Basic Protein Reactive T-Cell Clones in Patients with Multiple Sclerosis" *Autoimmunity* 28: 77-89.

Vasconcellos, Lauro M. et al. "Cytotoxic Lymphocyte Gene Expression in Peripheral Blood Leukocytes Correlates with Rejecting Renal Allografts" *Transplantation* 66 (5): 562-566.

Vignali D."Multiplexed particle-based flow cytometric assays" *J. Immun. Meth.* 243 (2000): 243-55.

Vincenti, F. et al. (2001) "Multicenter Trial Exploring Calcineurin Inhibitors Avoidance in Renal Transplantation" *Transplantation* 71 (9): 1282-1287.

Watanabe-Fukunaga, R. et al. (1992) "Lymphoproliferation disorder in mice explained by defects in Fas antigen that mediates apoptosis" *Nature* 356: 314-317.

Welsh, J. B. et al. "Analysis of gene expression profiles in normal and neoplastic ovarian tissue samples identifies candidate molecular markers of epithelial ovarian cancer" *Proc. Natl. Acad. Sci. U.S.A.* 98 (2001): 1176-81.

Westin L. et al. "Anchored multiplex amplification on a microelectronic chip array" *Nat. Biotechnol.* 18 (2000): 199-204.

Whitehead, John. 2002. An Introduction to Logistic Regression. (web page: http://personal.ecu.edu/whiteheadj/data/logit/). Apr. 25, 2002: 63 pages.

Wu, J. et al. (1996) "Fas ligand mutation in a patient with systemic lupus erythematosus and lymphoproliferative disease" *J. Clin. Invest.* 98: 1107-1113.

Xia, Dongyuan et al. (2001) "Real-Time Polymerase Chain Reaction Analysis Reveals an Evolution of Cytokine mRNA Production in Allograft Acceptor Mice" *Transplantation* 72 (5): 907-914.

Yu et al. (2000) "Protein Synthesis-Dependent and Independent Induction of p69 2'-5'-Oligoadenylate Synthetase by Interferon-α," *Cytokine*, 11:10, 744-750, p. 747.

Zucker, S. et al. (1999) "Increased serum stromelysin-1 levels in systemic lupus erythematosus: lack of correlation with disease activity." *J Rheumatol.* 26 (1): 78-80.

International Search Report mailed on Sep. 30, 2004, for PCT patent application No. PCT/US03/13015, 4 pages.

Higuchi et al. (1998), Chemical Abstracts 129: 342625: 7 pages.

Neto, E. D. et al. (2000). "Shotgun Sequencing of the Human Transcriptome with ORF Expressed Sequences Tags." Proceedings of the National Academy of Sciences, 97(7): 3491-3496.

Rebouillat et al. (1999) "The 100-kDa 2',5'-Oligoadenylate Synthase Catalyzing Preferentially the Synthesis of Dimeric pppA2'p5'A Molecules Is Composed of Three Homologous Domains" J. Biol. Chem. 274 (3): 1557-1565.

Zhang, L. et al. (1997) "A New Interferon Regulatory Factor Associated with Epstein=Barr Virus Latency." Molecular and Cellular Biology, 17(10): 5748-5757.

International Search Report mailed Sep. 23, 2005, for PCT application No. PCT/US03/12946, filed Apr. 24, 2003; 3 pages.

Australian Search Report mailed Oct. 7, 2005, for Singapore patent application No. SG 200406287-3, filed Apr. 24, 2003, 2 pages.

Bakke, Antony C. et al., (2001) "Neutrophil CD64 expression Distinguishing acute inflammatory autoimmune disease from systemic infections," Clinical and Applied Immunology Reviews, 1: 267-275.

Deuel, Thomas F. et al., (Jun. 1977) "Amino acid sequence of human platelet factor 4," Proc. Natl. Acad. Sci. USA, 74(6): 2256-2258.

Deuel, Thomas F. et al., (Jul. 1981) "Platelet 4 is chemotactic for neutrophils and monocytes," Proc. Natl. Acad. Sci. USA, 78(7): 4584-4587.

Dudek, Arkadiusz Z. et al., (Jun. 15, 2003) "Platelet factor 4 promotes adhesion of hematopoietic progenitor cells and binds IL-8: novel mechanisms for modulation of hematopoiesis," Blood, 101(12): 4687-4694.

Golden-Mason, Lucy et al., (Jun. 2000) "Differential Expression of Lymphoid and Myeloid Markers on Differentiating Hematopoietic Stem Cells in Normal and Tumor-Bearing Adult Human Liver," Hepatology, 31: 1251-1256.

Morris, Dale L. et al., (Feb. 1997) "Immunophenotyping Analysis of Peripheral Blood, Splenic, and Thymic Lymphocytes in Male and Female Rats," Journal of Pharmacological and Toxicological Methods, 57: 57-46.

Alizadeh, A. A. et al. (2000). "Genomic-Scale Gene Expression Profiling of Normal and Malignant Immune Cells," *Current Opinion in Immunology* 12:219-225.

Glynne, R. et al. (2000). "B-Lymphocyte Quiescence, Tolerance and Activation as Viewed by Global Gene Expression Profiling on Microarrays," *Immunological Reviews* 176:216-246.

Glynne, R. J. et al. (2000). "Genomic-Scale Gene Expression Analysis of Lymphocyte Growth, Tolerance and Malignancy," *Current Opinion in Immunology* 12:210-214.

Marrack, P. et al. (2000). "Genomic-Scale Analysis of Gene Expression in Resting and Activated T Cells," *Current Opinion in Immunology* 12:208-209.

Supplemental Partial European Search Report mailed Jul. 9, 2007, for EP Application No. 01997055.7 filed Oct. 22, 2001, 6 pages.

Amaro, A. et al. (1995). "Plasma Leukocyte Elastase Concentration in Angiographically Diagnosed Coronary Artery Disease," *European Heart Journal* 16:615-622.

Aukrust, P. et al. (1999). "Enhanced Levels of Soluble and Membrane-Bound CD40 Ligand in Patients with Unstable Angina. Possible Reflection of T Lymphocyte and Platelet Involvement in the Pathogenesis of Acute Coronary Syndromes," *Circulation* 100:614-620.

Bass, C. A. (Oct. 1993). "Clinical Evaluation of a New Polymerase Chain Reaction Assay for Detection of *Chlamydia trachomatis* in Endocervical Specimens," *Journal of Clinical Microbiology* 31(10):2648-2653.

Belch, J. J. F. et al. (Apr. 1997). "The White Blood Cell Adhesion Molecule E-Selectin Predicts Restenosis in Patients With Intermittent Claudication Undergoing Percutaneous Transluminal Angioplasty," *Circulation* 95(8):2027-2031.

Boelaert, M. et al. (May 1999). "Latent Class Analysis Permits Unbiased Estimates of the Validity of DAT for the Diagnosis of Visceral Leishmaniasis," *Tropical Medicine & International Health* 4(5):395-401.

Bustin, S. A. (2000). "Absolute Quantification of mRNA Using Real-Time Reverse Transcription Polymerase Chain Reaction Assays," *Journal of Molecular Endocrinology* 25:169-193.

Chen, J. et al. (Aug. 1996). "Identification of Differentially Expressed Genes in Rat Aortic Allograft Vasculopathy," *American Journal of Pathology* 149(2):597-611.

Fandrey, J. et al. (Feb. 1, 1993). "In Vivo and In Vitro Regulation of Erythropoietin mRNA: Measurement by Competitive Polymerase Chain Reaction," *Blood* 81(3):617-623.

Harlow, E. et al. (1988). *Antibodies: A Laboratory Manual.* Cold Spring Harbor Laboratory: New York, NY, 9 pages (Table of Contents).

Hayward, A. L. et al. (1998). "Modeling and Analysis of Competitive RT-PCR," *Nucleic Acids Research* 26(11):2511-2518.

Hayward-Lester, A. et al. (1995). "Accurate and Absolute Quantitative Measurement of Gene Expression by Single Tube RT-PCR and HPLC," *Genome Research* 5:494-499.

International Search Report mailed Jul. 18, 2002, for PCT Application No. PCT/US01/47856 filed Oct. 22, 2001, 3 pages.

International Search Report mailed Mar. 1, 2001, for PCT Application No. PCT/US00/17846 filed Jun. 28, 2000, 2 pages.

Jude, B. et al. (Oct. 1994). "Evidence for Time-Dependent Activation of Monocytes in the Systemic Circulation in Unstable Angina but Not in Acute Myocardial Infarction or in Stable Angina," *Circulation* 90(4):1662-1668.

Kang, J. J. et al. (2000). "Transcript Quantitation in Total Yeast Cellular RNA Using Kinetic PCR," *Nucleic Acids Research* 28(2):e2, 8 pages.

Kassirer, M. et al. (Sep. 1999). "Increased Expression of the CD11b/CD18 Antigen on the Surface of Peripheral White Blood Cells in Patients with Ischemic Heart Disease: Further Evidence for Smoldering Inflammation in Patients with Atherosclerosis," *American Heart Journal* 138(3):555-559.

Kendler, K. S. et al. (Jun. 1998). "The Structure of Psychosis Latent Class Analysis of Probands from the Roscommon Family Study," *Archives of General Psychiatry* 55:492-499.

Lee, M.-T. et al. (Aug. 29, 2000). "Importance of Replication in Microarray Gene Expression Studies: Statistical Methods and Evidence from Repetitive cDNA Hybridizations," *Proceedings of the National Academy of Sciences* 97(18):9834-9839.

Pickles, A. et al. (1995). "Latent-Class Analysis of Recurrence Risks for Complex Phenotypes with Selection and Measurement Error: A Twin and Family History Study of Autism," *American Journal of Human Genetics* 57:717-726.

Quattrone, A. et al. (1995). "Quantitation of bcl-2 Oncogene in Cultured Lymphoma/Leukemia Cell Lines and in Primary Leukemia B-Cells by a Highly Sensitive RT-PCR Method," *Haematologica* 80:495-504.

Ross, S. D. et al. (1999). "Reduced Neutrophil Infiltration Protects Against Lung Reperfusion Injury After Transplantation," *The Annals of Thoracic Surgery* 67: 1428-1434.

Smith-Norowitz, T. A. et al. (Nov. 1999). "Lymphocyte Activation in Angina Pectoris," *Clinical Immunology* 93(2):168-175.

Stites, D. P. et al. eds. (1991). *Basic and Clinical Immunology*. 7th Edition, Appleton & Lange: East Norwalk, CT, 6 pages (Table of Contents).

Thomas, E. et al. (Jul. 2000). "Subtyping of Juvenile Idiopathic Arthritis Using Latent Class Analysis," *Arthritis & Rheumatism* 43(7):1496-1503.

Tibshirani, R. et al. (May 2002). "Diagnosis of Multiple Cancer Types by Shrunken Centroids of Gene Expression," *Proceedings of the National Academy of Sciences* 99(1):6567-6572.

Vu, H. K. (2000). "A Method for Quantification of Absolute Amounts of Nucleic Acids by (RT)-PCR and a New Mathematical Model for Data Analysis," *Nucleic Acids Research* 28(7):e18, 9 pages.

Dietz, A. B. et al. (2000). "Maturation of Human Monocyte-Derived Dendritic Cells Studied by Microarray Hybridization," *Biochemical and Biophysical Research Communications* 275:731-738.

EMBL-EBI Accession No. AA053887, last updated Aug. 31, 2006, located at <http://www.ebi.ac.uk/cgi-bin/dbfetch?db=embl&id=AA053887&style=raw> visited on Oct. 31, 2007. (3 pages).

EMBL-EBI Accession No. AAC77576, located at <http://www.ebi.ac.uk/cgi-bin/dbfetch?db=emblcds&id=AAC77576&style=raw> visited on Oct. 31, 2007. (1 page).

EMBL-EBI Accession No. AAK80490, located at <http://www.ebi.ac.uk/cgi-bin/dbfetch?db=emblcds&id=AAK80490&style=raw> visited on Oct. 31, 2007. (1 page).

EMBL-EBI Accession No. AI775145, last updated Jun. 21, 2002, located at <http://www.ebi.ac.uk/cgi-bin/dbfetch?db=embl&id=AI755145&style=raw> visited on Oct. 31, 2007. (2 pages).

EMBL-EBI Accession No. AK000354, last updated Sep. 12, 2006, located at <http://www.ebi.ac.uk/cgi-bin/dbfetch?db=embl&id=AK000354&style=raw> visited on Oct. 31, 2007. (3 pages).

EMBL-EBI Accession No. AV742425, last updated Oct. 10, 2000, located at <http://www.ebi.ac.uk/cgi-bin/dbfetch?db=embl&id=AV742425&style=raw> visited on Oct. 31, 2007. (2 pages).

EMBL-EBI Accession No. AW969353, last updated Jun. 8, 2000, located at <http://www.ebi.ac.uk/cgi-bin/dbfetch?db=embl&id=AW969353&style=raw> visited on Oct. 31, 2007. (1 page).

EMBL-EBI Accession No. G06338, last updated Mar. 4, 2000, located at <http://www.ebi.ac.uk/cgi-bin/dbfetch?db=embl&id=G06338&style=raw> visited on Oct. 31, 2007. (2 pages).

EMBL-EBI Accession No. L26474, last updated Jan. 9, 2007, located at <http://www.ebi.ac.uk/cgi-bin/dbfetch?db=embl&id=L26474&style=raw> visited on Oct. 31, 2007. (6 pages).

EMBL-EBI Accession No. M23068, last updated Nov. 14, 2006, located at <http://www.ebi.ac.uk/cgi-bin/dbfetch?db=embl&id=M23068&style=raw> visited on Oct. 31, 2007. (2 pages).

EMBL-EBI Accession No. V00497, last updated Nov. 20, 2004, located at <http://www.ebi.ac.uk/cgi-bin/dbfetch?db=embl&id=V00497&style=raw> visited on Oct. 31, 2007. (5 pages).

Finger, L. R. et al. (1997). "The Human PD-1 Gene: Complete cDNA, Genomic Organization, and Developmentally Regulated Expression in B cell Progenitors," *Gene* 197:177-187.

Fullerton, S. M. et al. (Mar. 1994). "Molecular and Population Genetic Analysis of Allelic Sequence Diversity at the Human Beta-Globin Locus," *Proceedings of the National Academy of Sciences* 91:1805-1809.

Gorcynski, R. M. (1996). "Correlation of Peripheral Blood Lymphocyte and Intragraft Cytokine mRNA Expression with Rejection in Orthotopic Liver Transplantation," *Surgery* 120(3):496-502.

Griffiths, G. M. et al. (1991). "Granzyme A and Perforin as Markers for Rejection in Cardiac Transplantation," *European Journal of Immunology* 21:687-692.

Jardi, M. et al. (1994). "Urokinase Receptor (UPAR) Expression During Hematopoietic Maturation," *Journal of Drug Targeting* 8(Suppl 1):51.

Joulin, V. et al. (Oct. 25, 1988). "Isolation and Characterization of the Human 2,3-Bisphosphoglycerate Mutase Gene," *The Journal of Biological Chemistry* 263(30):15785-15790.

Krause, S. W. (1998). "Carboxypeptidase M as a Marker of Macrophage Maturation," *Immunological Reviews* 161:119-127.

Le Naour, F. et al. (May 25, 2001). "Profiling Changes in Gene Expression during Differentiation and Maturation of Monocyte-Derived Dendritic Cells Using Both Oligonucleotide Microarrays and Proteomics," *The Journal of Biological Chemistry* 276(21):17920-17931.

Supplementary European Search Report mailed Oct. 18, 2007, for EP Application No. 03799755.8 filed Apr. 24, 2003, 17 pages.

Tamayo, P. et al. (Mar. 1999). "Interpreting Patterns of Gene Expression with Self-Organizing Maps: Methods and Application to Hematopoietic Differentiation," *Proceedings of the National Academy of Sciences* 96:2907-2912.

Willems, R. et al. (May 29, 1998). "Decrease in Nucleoside Diphosphate Kinase (NDPK/nm23) Expression During Hematopoietic Maturation," *The Journal of Biological Chemistry* 273(22):13663-13668.

Ahern, H. (Jul. 24, 1995). "Biochemical, Reagent Kits Offer Scientists Good Return on Investment," *The Scientist* 9(15):20-24.

Cheung, V. et al. (Mar. 2003). "Natural Variation in Human Gene Expression Assessed in Lymphoblastoid Cells," *Nature Genetics* 33:422-425.

GenBank Accession No. Y10376, last updated May 14, 1997, located at <http://www.ncbi.nlm.nih.gov/entrez/viewer.fcgi?db=nuccore&id=2052057> visited on Apr. 8, 2008, 3 pages.

International Search Report and Written Opinion mailed Mar. 27, 2008, for PCT Application No. PCT/US05/31806 filed Sep. 8, 2005, 14 pages.

Newton, M. A. et al. (2001). "On Differential Variability of Expression Ratios: Improving Statistical Inference about Gene Expression Changes from Microarray Data," *Journal of Computational Biology* 8(1):37-52.

U.S. Office Action mailed Apr. 1, 2008, for U.S. Appl. No. 10/511,937, filed Jul. 22, 2005, 6 pages.

U.S. Office Action mailed Jun. 15, 2007, for U.S. Appl. No. 11/223,492, filed Sep. 8, 2005, 20 pages.

U.S. Office Action mailed Mar. 5, 2008, for U.S. Appl. No. 11/223,492, filed Sep. 8, 2005, 13 pages.

U.S. Office Action mailed Oct. 3, 2007, for U.S. Appl. No. 10/990,275, filed Nov. 15, 2004, 6 pages.

U.S. Appl. No. 10/512,028, filed Apr. 14, 2006 for Wohlgemuth et al.

U.S. Appl. No. 11/938,227, filed Nov. 9, 2007 for Lal et al.

Wu, T. (2001). "Analyzing Gene Expression Data from DNA Microarrays to Identify Candidate Genes," *Journal of Pathology* 195:53-65.

Shin, Young Kee et al., (Apr. 2001) "Expression of Leukemia-Associated antigen, JL1, in Bone Marrow and Thymus," American Journal of Pathology, 158(4): 1473-1480.

Stellrecht, Christine M. et al., (1991) "Expression pattern of a hematopoietic proteoglycan core protein gene during human hematopoiesis," Differentiation, 48: 127-135.

Weast, Ed. (1968). Handbook of Chemistry and Physics, 49th Ed., The Chemical Rubber Co.: Cleveland Ohio, p. A-245.

Bertone, P. et al. (Dec. 24, 2004). "Global Identification of Human Transcribed Sequences with Genome Tiling Arrays," *Science* 306:2242-2246.

Flechner, S. M. et al. (2004). "Kidney Transplant Rejection and Tissue Injury by Gene Profiling of Biopsies and Peripherals Blood Lymphocytes," *American Journal of Transplantation* 4:1475-1489.

Galon, J. et al. (Jan. 2002). "Gene Profiling Reveals Unknown Enhancing and Supppressive Actions of Glucocorticoids on Immune Cells," *The FASEB Journal* 16:61-71.

International Search Report and Written Opinion mailed Aug. 25, 2008, for PCT Application No. PCT/US07/08909 filed Apr. 9, 2007, 10 pages.

International Search Report and Written Opinion mailed Jun. 25, 2008, for PCT Application No. PCT/US06/18381 filed May 11, 2006, 8 pages.

Mansfield, E. S. et al. (2004). "Arraying the Orchestration of Allograft Pathology," *American Journal of Transplantation* 4:853-862.

Figure 1: Novel Gene Sequence Analysis
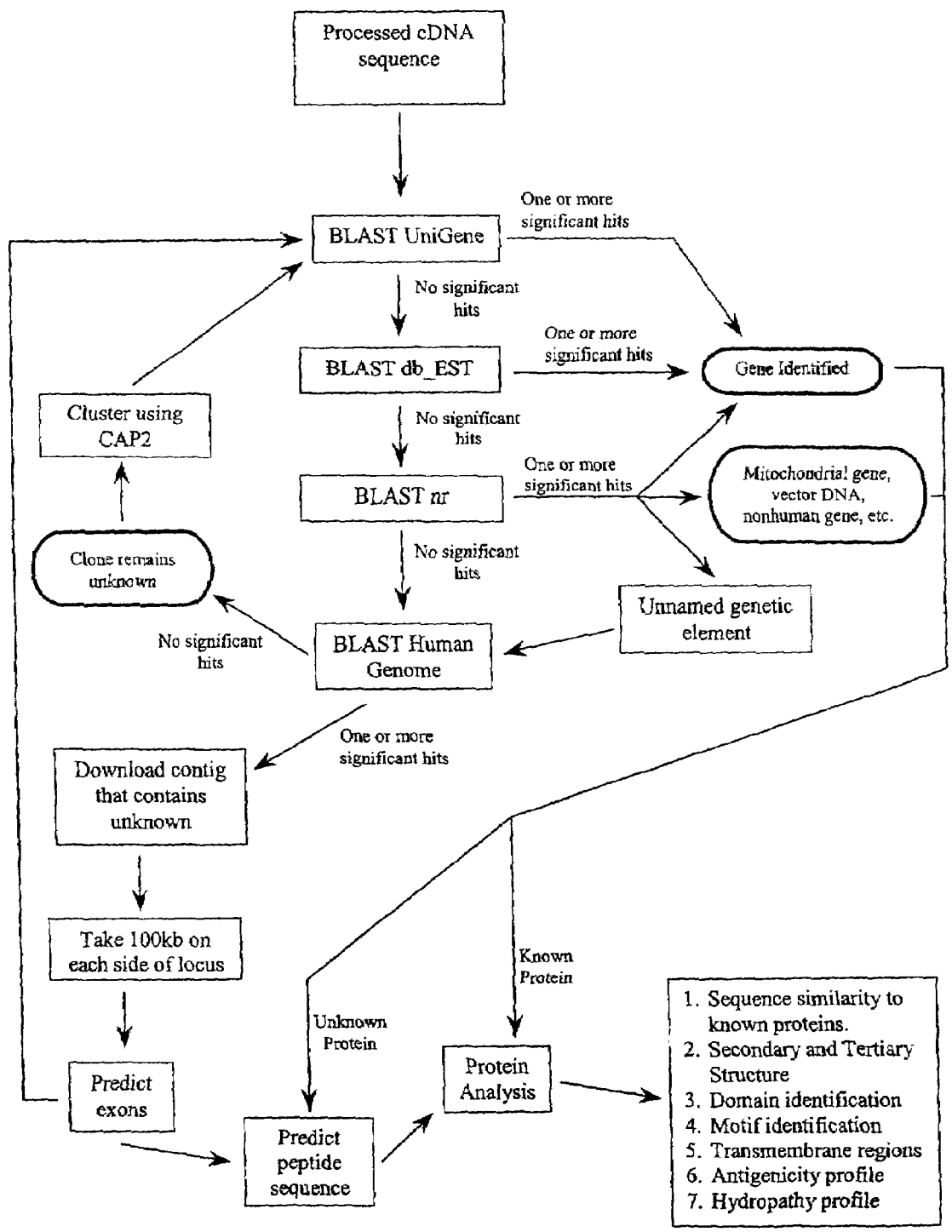

Figure 2: Primer efficiency testing. A standard curve of Ct versus log of the starting RNA amount is shown for 2 genes.
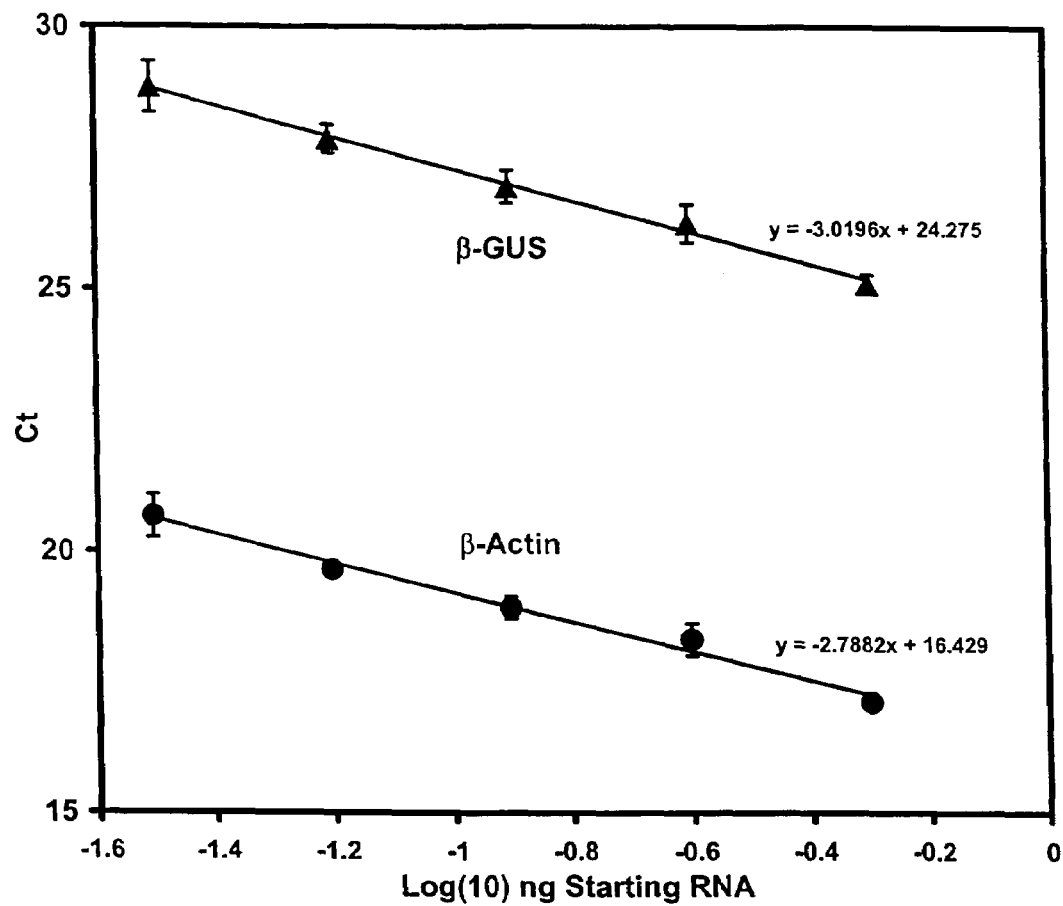

Figure 3: Kits for discovery of, or application of diagnostic gene sets

A. Contents of kit for discovery of diagnostic gene sets using microarrays

1. Sterile, endotoxin and RNAse free blood collection tubes
2. Alcohol swabs, tourniquet, blood collection set
3. -PBS (phosphate buffer saline; needed when method of example 8 is used to derived mononuclear RNA)
4. Cell lysis buffer
5. RNA isolation kit
6. Substrates for labeling of RNA (may vary for various expression profiling techniques)
    For fluorescence microarray expression profiling:
    Reverse transcriptase and 10x RT buffer
    T7(dT)24 primer (primer with T7 promoter at 5' end)
    DTT
    Deoxynucleotides 100mM each
    RNAse inhibitor
    $2^{nd}$ strand cDNA buffer
    DNA polymerase
    Rnase H
    T7 RNA polymerase
    Ribonucleotides
    In Vitro transcription buffer
    Cy3 and Cy5 labeled ribonucleotides
7. Microarrays containing candidate gene libraries
8. Cover slips for slides
9. Hybridization chambers
10. Software package for identification of diagnostic gene set from data
    Contains statistical methods.
    Allows alteration in desired sensitivity and specificity of gene set.
    Software facilitates access to and data analysis by centrally located database server.
11. Password and account number to access central database server.
12. Kit User Manual

B. Contents of kit for application of diagnostic gene sets using microarrays

1. Sterile, endotoxin and RNAse free blood collection tubes
2. Alcohol swabs, tourniquet, blood collection set
3. -PBS (phosphate buffer saline; needed when method of example 7 is used to derived mononuclear RNA)
4. Cell lysis buffer
5. RNA isolation kit
6. Substrates for labeling of RNA (may vary for various expression profiling techniques)

FIGURE 3

For fluorescence microarray expression profiling:
Reverse transcriptase and 10x RT buffer
T7(dT)24 primer (primer with T7 promoter at 5' end)
DTT
Deoxynucleotides 100mM each
RNAse inhibitor
$2^{nd}$ strand cDNA buffer
DNA polymerase
Rnase H
T7 RNA polymerase
Ribonucleotides
In Vitro transcription buffer
Cy3 and Cy5 labeled ribonucleotides
7. Microarrays containing candidate gene libraries
8. Cover slips for slides
9. Hybridization chambers
10. Software package for identification of diagnostic gene set from data
    Contains statistical methods.
    Allows alteration in desired sensitivity and specificity of gene set.
    Software facilitates access to and data analysis by centrally located database server.
11. Password and account number to access central database server.
12. Kit User Manual

C. Contents of kit for application of diagnostic gene sets using Real-time RT-PCR 1. Sterile, endotoxin and RNAse free blood collection tubes
2. Alcohol swabs, tourniquet, blood collection set
3. -PBS (phosphate buffer saline; needed when method of example 7 is used to derived mononuclear RNA)
4. Cell lysis buffer
5. RNA isolation kit
6. Substrates for real time RT-PCR (may vary for various real-time PCR techniques:
    poly dT primers, random hexamer primers
    Reverse Transcriptase and RT buffer
    DTT
    Deoxynucleotides 100 mM
    RNase H
    primer pairs for diagnostic and control gene set
    10x PCR reaction buffer
    Taq DNA polymerase
    Fluorescent probes for diagnostic and control gene set
    (alternatively, fluorescent dye that binds to only double stranded DNA)
    reaction tubes with or without barcode for sample tracking

FIGURE 3

96-well plates with barcode for sample identification, one barcode for entire set, or individual barcode per reaction tube in plate
7. Software package for identification of diagnostic gene set from data
    Contains statistical methods.
    Allows alteration in desired sensitivity and specificity of gene set.
    Software facilitates access to and data analysis by centrally located database server
8. Password and account number to access central database server.
9. Kit User Manual

FIGURE 3

Figure 5: SLE diagnostic genes and algorithms
A.
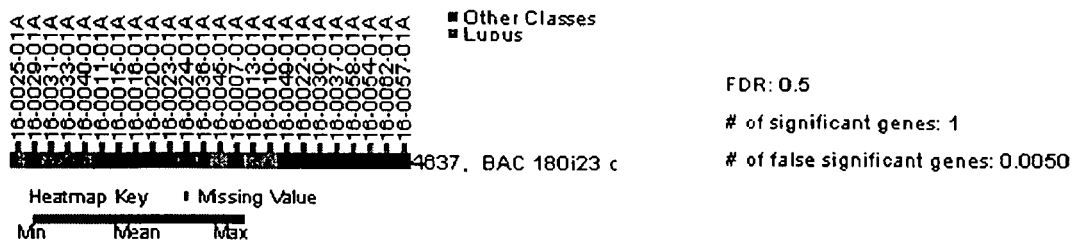
FDR: 0.5
# of significant genes: 1
# of false significant genes: 0.0050
B.
| Lupus | | Control | |
|---|---|---|---|
| Sample | Ratio | Sample | Ratio |
| 16-0022-01 | 1.05 | 16-0025-01 | 0.60 |
| 16-0030-01 | 0.96 | 16-0029-01 | 0.75 |
| 16-0037-01 | 0.87 | 16-0031-01 | 0.63 |
| 16-0058-01 | 1.05 | 16-0033-01 | 0.62 |
| 16-0054-01 | 0.99 | 16-0040-01 | 0.61 |
| 16-0062-01 | 0.98 | 16-0015-01 | 0.72 |
| 16-0057-01 | 1.14 | 16-0016-01 | 0.78 |
| | | 16-0020-01 | 0.79 |
| | | 16-0023-01 | 0.71 |
| | | 16-0024-01 | 0.69 |
| | | 16-0036-01 | 0.65 |
| | | 16-0045-01 | 0.59 |
| | | 16-0007-01 | 0.77 |
| | | 16-0013-01 | 0.60 |
| | | 16-0010-01 | 0.57 |
| | | 16-0049-01 | 0.75 |
|  | Lupus | Controls |
|---|---|---|
| Average Ratio | 1.00 | 0.68 |
| Std Dev of Ratio | 0.08 | 0.08 |
| Fold Change | 1.48 | |
FIGURE 5A-B

C.

| Model | # genes | Relative Cost | SEQ/Oligo-ID | Locus | Nominal Description | CART Splitter | CART Value for Dx SLE |
|---|---|---|---|---|---|---|---|
| Model I | 2 | 0.118 | 2412 | NM_002946 | replication protein A2 (32kD) | co-1st | [(2412)*0.903 - (2648)*0.431] <= 0.1909 |
|  |  |  | 2648 | NM_004510 | interferon-induced protein 75 | co-1st | [(2412)*0.903 - (2648)*0.431] <= 0.1909 |
| Model I | 3 | 0.125 | 2412 | NM_002946 | replication protein A2 (32kD) | co-1st | [(2412)*0.903 - (2648)*0.431] <= 0.1909 |
|  |  |  | 2648 | NM_004510 | interferon-induced protein 75 | co-1st | [(2412)*0.903 - (2648)*0.431] <= 0.1909 |
|  |  |  | 1436 | BC002409 | actin, beta (ACTB) | 2nd | (G1436) > 0.0868 |
| Model II | 1 | 0.612 | 5067 | W16552 | capicua protein (CIC) mRNA | 1st | (5067) > 0.1030 |
| Model II | 3 | 0.686 | 5067 | W16552 | capicua protein (CIC) mRNA | 1st | (5067) > 0.1030 |
|  |  |  | 1025 | AK024756 | hypothetical protein FLJ21103 | 2nd | (G1025) <= 0.3968 |
|  |  |  | 1035 | AK024969 | hypothetical protein DKFZp566I133 | 3rd | (G1035) <= 0.0073 |
| Model II | 5 | 0.745 | 5067 | W16552 | capicua protein (CIC) mRNA | 1st | (5067) > 0.1030 |
|  |  |  | 1003 | AK024240 | cDNA FLJ14178 fis | 2nd | (G1003) > 0.2105 |
|  |  |  | 1025 | AK024756 | hypothetical protein FLJ21103 | 2nd | (G1025) <= 0.3968 |
|  |  |  | 1001 | AK024202 | heat shock 90kD protein 1, alpha | 3rd | (G1001) <= -0.3107 |
|  |  |  | 1035 | AK024969 | hypothetical protein DKFZp566I133 | 3rd | (G1035) <= 0.0073 |

D.

|  | Model | Sensitivity | Specificity | Relative Cost |
|---|---|---|---|---|
| Training Set | Model 1 (2 genes) | 100 | 94 |  |
|  | Model 1 (3 genes) | 100 | 100 |  |
| 10-fold Cross Validation | Model 1 (2 genes) | 100 | 88 | 0.118 |
|  | Model 1 (3 genes) | 93 | 94 | 0.125 |

FIGURE 5C-D

E.
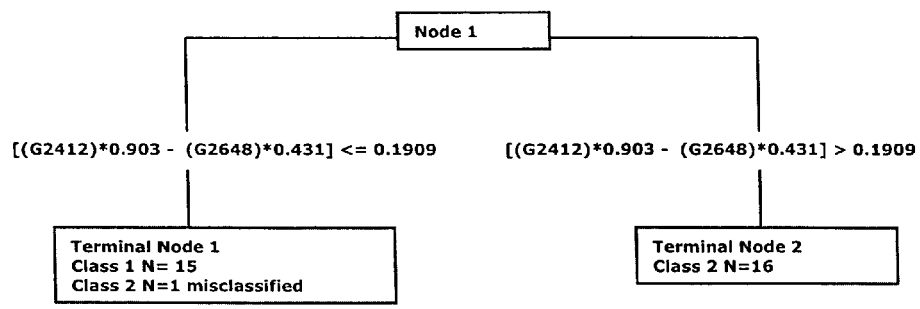
Model I (2 genes)
F.
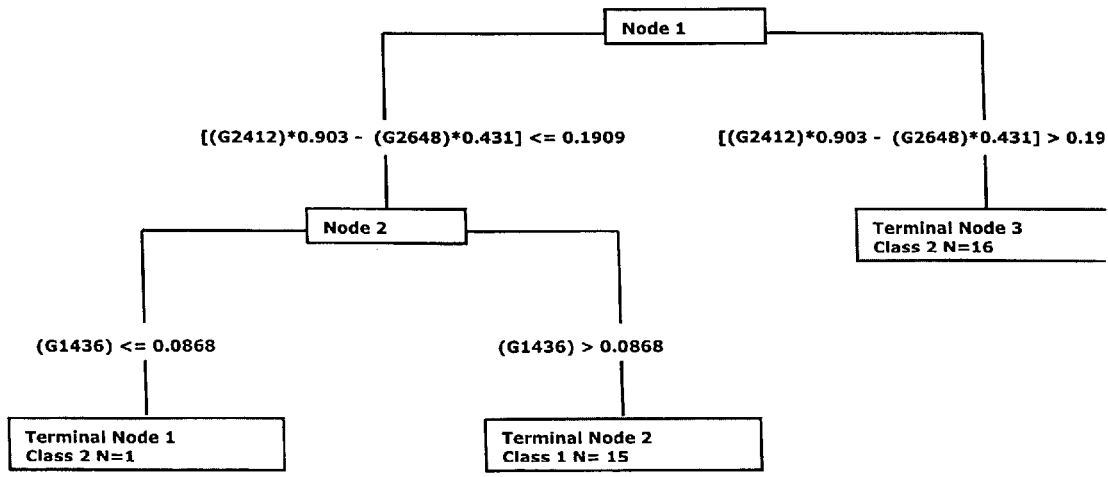
Model 1 (3 genes)
FIGURE 5E-F

Figure 6. Endpoint testing of PCR primers
A.
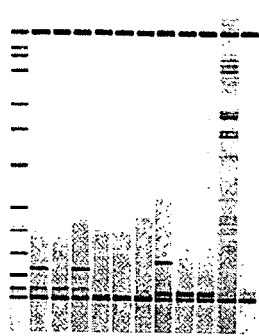
B.
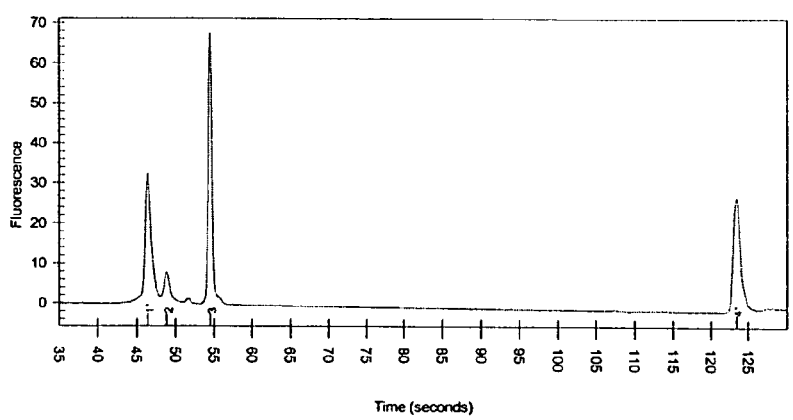
C.
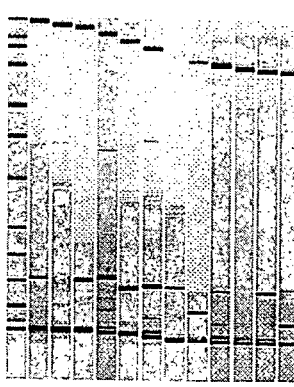
D.
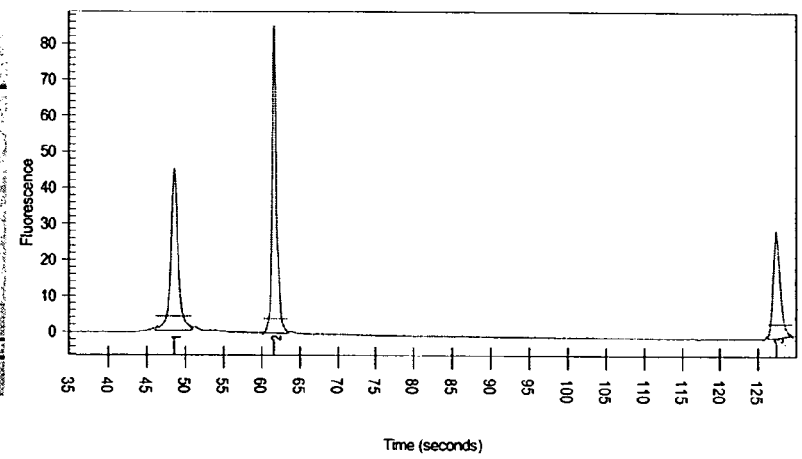

Figure 7: Validation of differential expression of Granzyme B in CMV patients using Real-time PCR

A.

METHODS AND COMPOSITIONS FOR DIAGNOSING OR MONITORING AUTOIMMUNE AND CHRONIC INFLAMMATORY DISEASES

RELATED APPLICATIONS

This application is a divisional of Application No. 10/131,827, filed Apr. 24, 2002, now U.S. Pat. No. 6,905,827, which is a continuation-in-part of App. Ser. No. 10/006,290, filed Oct. 22, 2001, now abandoned, which claims the benefit of U.S. Provisional App. No. 60/296,764, filed Jun. 8, 2001, all of which are hereby incorporated by reference in their entirety.

FIELD OF THE INVENTION

This application is in the field of chronic inflammatory diseases. In particular, this invention relates to methods and compositions for diagnosing or monitoring chronic inflammatory diseases.

BACKGROUND OF THE INVENTION

Many of the current shortcomings in diagnosis, prognosis, risk stratification and treatment of disease can be approached through the identification of the molecular mechanisms underlying a disease and through the discovery of nucleotide sequences (or sets of nucleotide sequences) whose expression patterns predict the occurrence or progression of disease states, or predict a patient's response to a particular therapeutic intervention. In particular, identification of nucleotide sequences and sets of nucleotide sequences with such predictive value from cells and tissues that are readily accessible would be extremely valuable. For example, peripheral blood is attainable from all patients and can easily be obtained at multiple time points at low cost. This is a desirable contrast to most other cell and tissue types, which are less readily accessible, or accessible only through invasive and aversive procedures. In addition, the various cell types present in circulating blood are ideal for expression profiling experiments as the many cell types in the blood specimen can be easily separated if desired prior to analysis of gene expression. While blood provides a very attractive substrate for the study of diseases using expression profiling techniques, and for the development of diagnostic technologies and the identification of therapeutic targets, the value of expression profiling in blood samples rests on the degree to which changes in gene expression in these cell types are associated with a predisposition to, and pathogenesis and progression of a disease.

There is an extensive literature supporting the role of leukocytes, e.g., T-and B-lymphocytes, monocytes and granulocytes, including neutrophils, in a wide range of disease processes, including such broad classes as cardiovascular diseases, inflammatory, autoimmune and rheumatic diseases, infectious diseases, transplant rejection, cancer and malignancy, and endocrine diseases.

Of particular interest is the role of leukocytes and leukocyte gene expression in chronic inflammatory diseases such as Systemic Lupus Erythematosis and Rheumatoid Arthritis. Systemic lupus erythematosis (SLE) and Rheumatoid Arthritis (RA) are chonic autoimmune and inflammatory disorders characterized by dysregulation of the immune system, which causes damage to a variety of organs. These diseases clearly involve differential expression of genes in leukocytes. Diagnostic and disease monitoring tools are severly lacking for these patients and their physicians. Leukocyte expression profiling can be applied to discover expression markers for SLE and RA and apply them as patient management tools in the clinical setting. In addition, osteoarthirtis is a degenerative joint disease that can be confused with RA. This disease also involves leukocytes and expression profiling of leukocytes associated with osteoarthritis may lead to the discovery of new diagnostic and therapeutic approaches to the disease.

The accuracy of technologies based on expression profiling for the diagnosis, prognosis, and monitoring of disease would be dramatically increased if numerous differentially expressed nucleotide sequences, each with a measure of sensitivity and specificity for a disease in question, could be identified and assayed in a concerted manner. Using the expression of multiple genes (gene sets) for diagnostic applications helps overcome assay and population variability. In order to achieve this improved accuracy, the appropriate sets of nucleotide sequences need to be identified and validated against numerous samples in combination with relevant clinical data.

SUMMARY OF THE INVENTION

In order to meet these needs, the present invention identifies genes and gene sets that have clinical utility as diagnostic tools for the management of transplant recipients, lupus patients and patients with a variety of chronic inflammatory and autoimmune diseases. The present invention is thus directed to a method of diagnosing or monitoring chronic autoimmune or inflammatory disease in a patient. The method of the invention involves detecting in a patient expression of one or more genes such as those genes depicted in Table 8 and Table 10 A and surrogates derived therefrom. Exemplary surrogates are provided in Table 10C. The present invention is further directed to a method of diagnosing or monitoring an autoimmune or chronic inflammatory disease in a patient by detecting the expression level of one or more genes or surrogates derived therefrom in said patient to diagnose or monitor the autoimmune or chronic inflammatory disease in the patient wherein said genes include a nucleotide sequence selected from SEQ ID NO: 41; SEQ ID NO:328; SEQ ID NO:668; SEQ ID NO:855; SEQ ID NO:981; SEQ ID NO:1001; SEQ ID NO:1003; SEQ ID NO:1025; SEQ ID NO:1035; SEQ ID NO:1227; SEQ ID NO:1341; SEQ ID NO:1390; SEQ ID NO:1436; SEQ ID NO:1535; SEQ ID NO:1750; SEQ ID NO:2102; SEQ ID NO:2331; SEQ ID NO:2386; SEQ ID NO:2412; SEQ ID NO:2560; SEQ ID NO:2648; SEQ ID NO:2895, SEQ ID NO:3249; SEQ ID NO:3305; SEQ ID NO:3541; SEQ ID NO:3692; SEQ ID NO:3701; SEQ ID NO:3741; SEQ ID NO:3825; SEQ ID NO:3827; SEQ ID NO:3832; SEQ ID NO:4149; SEQ ID NO:4400; SEQ ID NO:4601; SEQ ID NO:4604; SEQ ID NO:4631; SEQ ID NO:4637; SEQ ID NO:5067; SEQ ID NO:5074; SEQ ID NO:5468; SEQ ID NO:5531; SEQ ID NO:5607; SEQ ID NO:6382; SEQ ID NO:6956; SEQ ID NO:7238; SEQ ID NO:7330; SEQ ID NO:7641; SEQ ID NO:8015 and SEQ ID NO:8095.

In the method of the invention, the chronic inflammatory disease or autoimmune disease may be systemic lupus erythematosis (SLE).

In one format, expression is detecting by measuring RNA levels or protein levels from the genes.

In the method of the invention, RNA may be isolated from the patient prior to detecting expression of a gene such as those depicted in Table 10A. RNA levels may be detected by PCR, hybridization. such as hybridization to an oligonucleotide. The nucleotide sequence may include comprises DNA, cDNA, PNA, genomic DNA, or synthetic oligonucleotides.

In the methods of the invention, the RNA may be detected by hybridization to an oligonucleotide having a nucleotide sequence selected from SEQ ID NO: 41; SEQ ID NO:328; SEQ ID NO:668; SEQ ID NO:855; SEQ ID NO:981; SEQ ID NO:1001; SEQ ID NO:1003; SEQ ID NO:1025; SEQ ID NO:1035; SEQ ID NO:1227; SEQ ID NO:1341; SEQ ID NO:1390; SEQ ID NO:1436; SEQ ID NO:1535; SEQ ID NO:1750; SEQ ID NO:2102; SEQ ID NO:2331; SEQ ID NO:2386; SEQ ID NO:2412; SEQ ID NO:2560; SEQ ID NO:2648; SEQ ID NO:2895, SEQ ID NO:3249; SEQ ID NO:3305; SEQ ID NO:3541; SEQ ID NO:3692; SEQ ID NO:3701; SEQ ID NO:3741; SEQ ID NO:3825; SEQ ID NO:3827; SEQ ID NO:3832; SEQ ID NO:4149; SEQ ID NO:4400; SEQ ID NO:4601; SEQ ID NO:4604; SEQ ID NO:4631; SEQ ID NO:4637; SEQ ID NO:5067; SEQ ID NO:5074; SEQ ID NO:5468; SEQ ID NO:5531; SEQ ID NO:5607; SEQ ID NO:6382; SEQ ID NO:6956; SEQ ID NO:7238; SEQ ID NO:7330; SEQ ID NO:7641; SEQ ID NO:8015 and SEQ ID NO:8095.

The present invention is further directed to a diagnostic oligonucleotide for detecting chronic or inflammatory disease wherein the oligonucleotide has a nucleotide sequence selected from SEQ ID NO: 4637, The diagnostic oligonucleotide of may include DNA, cDNA, PNA, genomic DNA, or synthetic oligonucleotides.

The present invention is further directed to a system or kit for diagnosing or monitoring chronic inflammatory or autoimmune disease in a patient comprising an isolated DNA molecule wherein the isolated DNA molecule detects expression of a gene listed in Table 10A. In the system of the invention, the DNA molecules may be synthetic DNA, genomic DNA, PNA or cDNA. The isolated DNA molecule may be immobilized on an array. Such arrays may include a chip array, a plate array, a bead array, a pin array, a membrane array, a solid surface array, a liquid array, an oligonucleotide array, polynucleotide array or a cDNA array, a microtiter plate, a membrane and a chip.

The present invention is further directed to a system or detecting differential gene expression. In one format, the system has one or more isolated DNA molecules wherein each isolated DNA molecule detects expression of a gene selected from the group of genes corresponding to the oligonucleotides depicted in the Sequence Listing. It is understood that the DNA sequences and oligonucleotides of the invention may have slightly different sequences than those identified herein. Such sequence variations are understood to those of ordinary skill in the art to be variations in the sequence which do not significantly affect the ability of the sequences to detect gene expression.

The sequences encompassed by the invention have at least 40-50, 50-60, 70-80, 80-85, 85-90, 90-95 or 95-100% sequence identity to the sequences disclosed herein. In some embodiments, DNA molecules are less than about any of the following lengths (in bases or base pairs): 10,000; 5,000; 2500; 2000; 1500; 1250; 1000; 750; 500; 300; 250; 200; 175; 150; 125; 100; 75; 50; 25; 10. In some embodiments, DNA molecule is greater than about any of the following lengths (in bases or base pairs): 10; 15; 20; 25; 30; 40; 50; 60; 75; 100; 125; 150; 175; 200; 250; 300; 350; 400; 500; 750; 1000; 2000; 5000; 7500; 10000; 20000; 50000. Alternately, a DNA molecule can be any of a range of sizes having an upper limit of 10,000; 5,000; 2500; 2000; 1500; 1250; 1000; 750; 500; 300; 250; 200; 175; 150; 125; 100; 75; 50; 25; or 10 and an independently selected lower limit of 10; 15; 20; 25; 30; 40; 50; 60; 75; 100; 125; 150; 175; 200; 250; 300; 350; 400; 500; 750; 1000; 2000; 5000; 7500 wherein the lower limit is less than the upper limit.

The gene expression system may be a candidate library, a diagnostic agent, a diagnostic oligonucleotide set or a diagnostic probe set. The DNA molecules may be genomic DNA, protein nucleic acid (PNA), cDNA or synthetic oligonucleotides.

In one format, the gene expression system is immobilized on an array. The array may be a chip array, a plate array, a bead array, a pin array, a membrane array, a solid surface array, a liquid array, an oligonucleotide array, a polynucleotide array, a cDNA array, a microfilter plate, a membrane or a chip.

BRIEF DESCRIPTION OF THE SEQUENCE LISTING

A brief description of the sequence listing is given below. There are 9090 entries. The Sequence Listing presents 50mer oligonucleotide sequences derived from human leukocyte, plant and viral genes. These are listed as SEQ IDs 1-8143. The 50mer sequences and their sources are also displayed in Table 8. Most of these 50mers were designed from sequences of genes in Tables 2, 3A, B and C and the Sequence listing.

SEQ IDs 8144-8766 are the cDNA sequences derived from human leukocytes that were not homologous to UniGene sequences or sequences found in dbEST at the time they were searched. Some of these sequences match human genomic sequences and are listed in Tables 3B and C. The remaining clones are putative cDNA sequences that contained less than 50% masked nucleotides when submitted to RepeatMasker, were longer than 147 nucleotides, and did not have significant similarity to the UniGene Unique database, dbEST, the NR nucleotide database of Genbank or the assembled human genome of Genbank.

SEQ IDs 8767-8770, 8828-8830 and 8832 are sequences that appear in the specification (primer, masked sequences, exemplary sequences, etc.).

SEQ IDs 8845-8893 are the full length gene sequences for the genes identified by an accession number in Table 10A.

SEQ IDs 8894-9085 are the primer sequences for lupus genes identified in Table 10B.

BRIEF DESCRIPTION OF THE FIGURES

FIG. 1: FIG. 1 is a schematic flow chart illustrating an instruction set for characterization of the nucleotide sequence and/or the predicted protein sequence of novel nucleotide sequences.

FIG. 2: FIG. 2 shows PCR Primer efficiency testing. A standard curve of Ct versus log of the starting RNA amount is shown for 2 genes.

FIG. 3: FIG. 3 describes kits useful for the practice of the invention. FIG. 3A describes the contents of a kit useful for the discovery of diagnostic nucleotide sets using microarrays. FIG. 3B describes the contents of a kit useful for the application of diagnostic nucleotide sets using microarrays. FIG. 3C describes contents of a kit useful for the application of diagnostic nucleotide sets using real-time PCR.

FIG. 4 depicts a graph comparing the median background subtracted expression signals for various leukocyte reference RNAs.

FIG. 5: FIG. 5 depicts Diagnostic genes, gene sets and diagnostic algorithms for Systemic Lupus Erythematosis are identified. FIG. 5A shows the relative expression level of oligonucleotide and SEQ ID # 4637 (Sialyltransferase 4A) between Lupus and control samples is shown. The gene is identified as having a false detection rate for differential expression from the SAM algorithm of 0.5%. FIG. 5B shows the scaled ratios (non log) for Sialyltransferase (SEQ ID #

4637) are given for the samples in the analysis. The average ratio of each group along with the standard deviation of the ratio is shown. The average fold change from control to Lupus is 1.48. FIG. 5C shows CART gene expression models for diagnosis of SLE. For each model, the number of genes used, the relative cost with 10 fold cross validation, the SEQ ID, Locus accession number, the name and the position and values in the CART model are given. The CART values given are the expression level thresholds for classification of the sample as SLE after the node. For example, in the single gene model II, the first node of the decision tree asks if expression of gene 5067 is >0.103. If yes, the sample is placed in the lupus class. FIG. 5D shows the sensitivity and specificity of Model 1. The sensitivity and specificity are given for both the 2 and 3 gene models and both the training set and on cross validation. The relative cost is given for cross-validation. FIG. 5E shows the CART Model I, 2 genes. The model uses 2 genes in a single node to classify samples as Lupus (Class 1) or non-Lupus (Class 2). FIG. 5F shows CART Model I, 3 genes. The model uses a second node to classify all samples correctly as lupus (class 1) or non-lupus (class 2) for the training set.

FIG. 6: FIG. 6 shows endpoint testing of PCR primers. Electrophoresis and microfluidics are used to assess the product of gene specific PCR primers. FIG. 6A is a β-GUS gel image. Lane 3 is the image for primers F178 and R242. Lanes 2 and 1 correspond to the no-template control and −RT control, respectively. FIG. 6B shows the electropherogram of β-GUS primers F178 and R242, a graphical representation of Lane 3 from the gel image. FIG. 6C shows a β-Actin gel image. Lane 3 is the image for primers F75 and R178. Lanes 2 and 1 correspond to the no-template control and −RT control, respectively. FIG. 6D shows the electropherogram of β-Actin primers F75 and R178, a graphical representation of Lave 3 from the gel image.

FIG. 7: FIG. 7 shows the validation of differential expression of a gene discovered using microarrays using Real-time PCR.

BRIEF DESCRIPTION OF THE TABLES

Figure 4:
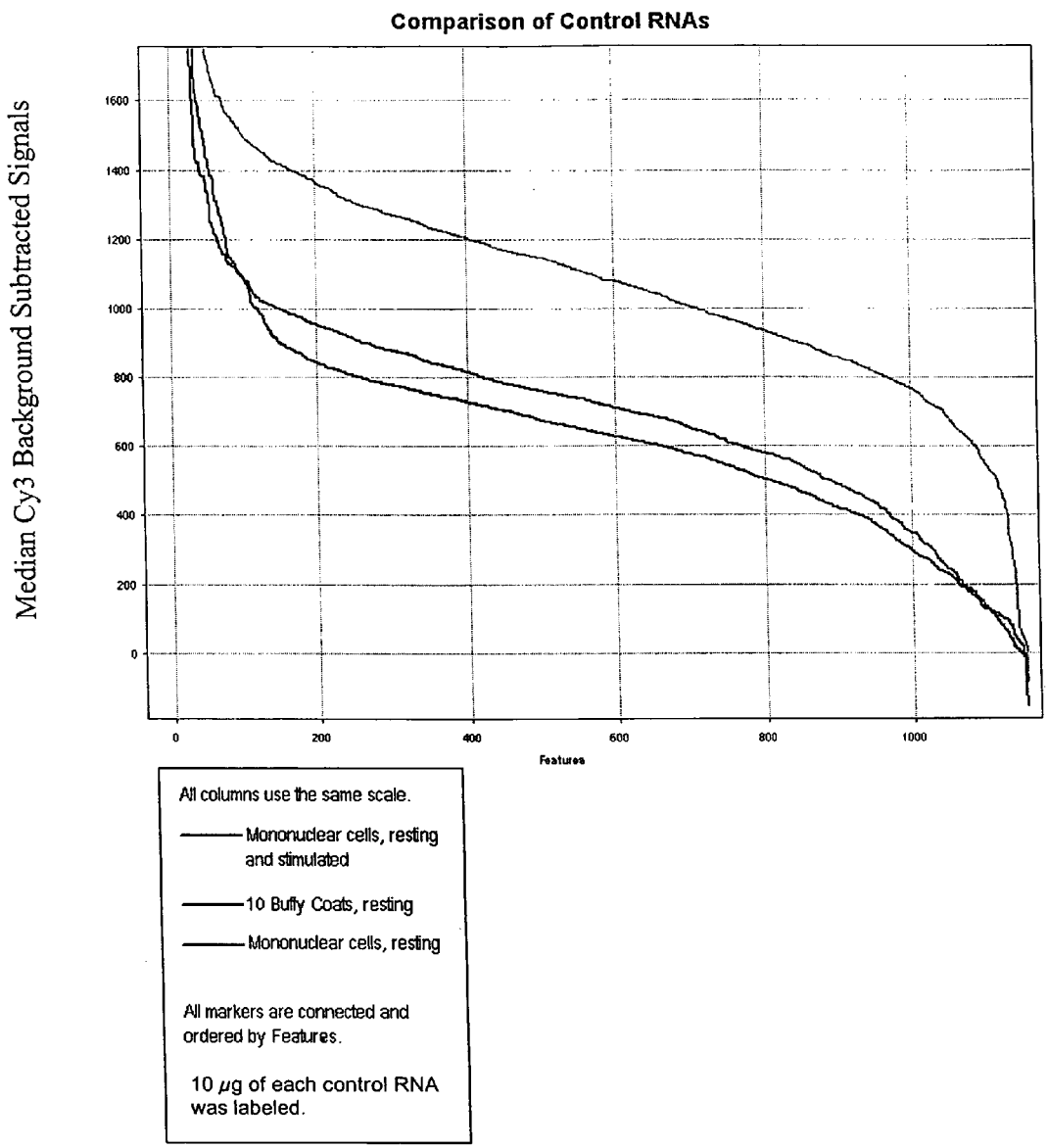
FIG. 4.

Table 1: Table 1 lists some of the diseases or conditions amenable to study by leukocyte profiling.

Table 2: Table 2 describes genes and other nucleotide sequences identified using data mining of publically available publication databases and nucleotide sequence databases. Corresponding Unigene (build 133) cluster numbers are listed with each gene or other nucleotide sequence.

Table 3A: Table 3A describes differentially expressed nucleotide sequences useful for the prediction of clinical outcomes. This table contains 4517 identified cDNAs and cDNA regions of genes that are members of a leukocyte candidate library, for use in measuring the expression of nucleotide sequences that could subsequently be correlated with human clinical conditions. The regions of similarity were found by searching three different databases for pair wise similarity using blastn. The three databases were UniGene Unique build Mar. 30, 2001, file Hs.seq.uniq.Z; the downloadable database located at the website ftp.ncbi.nlm.nih.com/blast/db/est human.Z with date Apr. 8, 2001 which is a section of Genbank version 122; and the non-redundant section of Genbank ver 123. The Hs.XXXXX numbers represent UniGene accession numbers from the Hs.seq.uniq.Z file of Mar. 30, 2001. The clone sequences are not in the sequence listing.

Table 3B: Table 3B describes Identified Genomic Regions that code for novel mRNAs. The table contains 591 identified genomic regions that are highly similar to the cDNA clones. Those regions that are within ~100 to 200 Kb of each other on the same contig are likely to represent exons of the same gene. The indicated clone is exemplary of the cDNA clones that match the indicated genomic region. The "number clones" column indicates how many clones were isolated from the libraries that are similar to the indicated region of the chromosome. The probability number is the likelihood that region of similarity would occur by chance on a random sequence. The Accession numbers are from the Mar. 15, 2001 build of the human genome. The file date for the downloaded data was Apr. 17, 2001. These sequences may prove useful for the prediction of clinical outcomes.

Table 3C: Table 3C describes 48 clones whose sequences align to two or more non-contiguous sequences on the same assembled human contig of genomic sequence. The Accession numbers are from the Mar. 15, 2001 build of the human genome. The file date for the downloaded data was Apr. 17, 2001. The alignments of the clone and the contig are indicated in the table. The start and stop offset of each matching region is indicated in the table. The sequence of the clones themselves is included in the sequence listing. The alignments of these clones strongly suggest that they are novel nucleotide sequences. Furthermore, no EST or mRNA aligning to the clone was found in the database. These sequences may prove useful for the prediction of clinical outcomes.

Table 4: Database mining. The Library Browser at the NCBI UniGene web site was used to identify genes that are specifically expressed in leukocyte cell populations. The table lists the library name and type, the number of sequences in each library and the number used for the array.

Table 5: Table 5 describes the nucleotide sequence databases used in the sequence analysis described herein.

Table 6: Table 6 describes the algorithms and software packages used for exon and polypeptide prediction used in the sequence analysis described herein.

Table 7: Table 7 describes the databases and algorithms used for the protein sequence analysis described herein.

Table 8: Table 8 provides a listing of all oligonucleotides designed for the arrays and their associated genes. In this table, the sequence ID is given which corresponds to the sequence listing. The origin of the sequence for inclusion on the array is noted as coming from one of the cDNA libraries described in example 1, mining from databases as described in examples 2 and 11 or identification from the published literature. The unigene number, genebank accession and GI number are also given for each sequence when known. These data were obtained from the Unigene unique database, build 137. The name of the gene associated with the accession number is noted. The sequence of these genes as available from the databases are hereby incorporated by reference in their entirety. The strand is noted as −1 or 1, meaning that the probe was designed from the complement of the sequence (−1) or directly from the sequence (1). The nucleotide sequence of each probe is also given in the Sequence Listing.

Table 9: Table 9 shows viral genes for arrays. Viral genomes were used to design oligonucleotides for the microarrays. The accession numbers for the viral genomes used are given, along with the gene name and location of the region used for oligonucleotide design.

Table 10A. Table 10A shows Lupus gene expression markers. This table lists the oligonucleotides and associated genes identified as having value for the diagnosis and monitoring of lupus. The first column gives the SEQ ID that corresponds to the oligonuclotide in the sequence listing. The origin of the sequence for inclusion on the array is noted as coming from one of the cDNA libraries described in example 1, mining from databases as described in examples 2 and 11 or identification from the published literature. The unigene number, genebank accession and GI number are also given for each sequence when known. The SEQ ID for the sequence listing for the full-length genes corresponding to the accession numbers in the table are also given (SEQ ID ACC). These data were obtained from the Unigene unique database, build ###. The name of the gene associated with the accession number is noted. The strand is noted as −1 or 1, meaning that the probe was designed from the complement of the sequence (−1) or directly from the sequence (1). Next, the nucleotide sequence of each probe is also given. For each gene, the false detection rate (FDR) from the significance analsysis described in example 10 is given if applicable. Also, those genes that were identified by CART as a diagnostic gene are noted with the model and position in the model (see example 10 and FIG. 5).

Table 10B. Table 10B shows primers for PCR. For each of the lupus gene expression markers identified in Table 10A, 2 sets of PCR primer pairs are shown that were derived by the methods described in example 15. The melting temperature (Tm) for each primer is shown, as is the corresponding SEQ ID number for the primer in the sequence listing.

Table 10C. Table 10C shows surrogates for the lupus gene expression markers disclosed herein. For some of the lupus marker genes identified in Table 10A, genes are identified by the SEQ ID number as surrogates. The surrogates are identified as such by the CART algorithm or by hierarchical clustering as detailed below.

DETAILED DESCRIPTION OF THE INVENTION

Definitions

Unless defined otherwise, all scientific and technical terms are understood to have the same meaning as commonly used in the art to which they pertain. For the purpose of the present invention, the following terms are defined below.

In the context of the invention, the term "gene expression system" refers to any system, device or means to detect gene expression and includes diagnostic agents, candidate libraries oligonucleotide, oligonucleotide sets or probe sets.

The terms "diagnostic oligonucleotide" or "diagnostic oligonucleotide set" generally refers to an oligonucleotide or to a set of two or more oligonucleotides that, when evaluated for differential expression their corresponding diagnostic genes, collectively yields predictive data. Such predictive data typically relates to diagnosis, prognosis, monitoring of therapeutic outcomes, and the like. In general, the components of a diagnostic oligonucleotide or a diagnostic oligonucleotide set are distinguished from oligonucleotide sequences that are evaluated by analysis of the DNA to directly determine the genotype of an individual as it correlates with a specified trait or phenotype, such as a disease, in that it is the pattern of expression of the components of the diagnostic oligonucleotide set, rather than mutation or polymorphism of the DNA sequence that provides predictive value. It will be understood that a particular component (or member) of a diagnostic oligonucleotide set can, in some cases, also present one or more mutations, or polymorphisms that are amenable to direct genotyping by any of a variety of well known analysis methods, e.g., Southern blotting, RFLP, AFLP, SSCP, SNP, and the like.

A "diagnostic gene" is a gene whose expression is detected by a diagnostic oligonucleotide or diagnostic oligonucleotide set.

A "disease specific target oligonucleotide sequence" is a gene or other oligonucleotide that encodes a polypeptide, most typically a protein, or a subunit of a multi-subunit protein, that is a therapeutic target for a disease, or group of diseases.

A "candidate library" or a "candidate oligonucleotide library" refers to a collection of oligonucleotide sequences (or gene sequences) that by one or more criteria have an increased probability of being associated with a particular disease or group of diseases. The criteria can be, for example, a differential expression pattern in a disease state or in activated or resting leukocytes in vitro as reported in the scientific or technical literature, tissue specific expression as reported in a sequence database, differential expression in a tissue or cell type of interest, or the like. Typically, a candidate library has at least 2 members or components; more typically, the library has in excess of about 10, or about 100, or about 1000, or even more, members or components.

The term "disease criterion" is used herein to designate an indicator of a disease, such as a diagnostic factor, a prognostic factor, a factor indicated by a medical or family history, a genetic factor, or a symptom, as well as an overt or confirmed diagnosis of a disease associated with several indicators such as those selected from the above list. A disease criterian includes data describing a patient's health status, including retrospective or prospective health data, e.g. in the form of the patient's medical history, laboratory test results, diagnostic test result, clinical events, medications, lists, response(s) to treatment and risk factors, etc.

An autoimmune disorder is defined as a disease state in which a patient's immune system recognizes an antigen in that patient's organs or tissues as foreign and becomes activated. The activated immune cells can then cause damage to the inciting organ or tissue or can damage other organs or tissues. In some cases, the disorder may be caused by a dysregulation of the immune system cells, rather than by the recognition as a self-antigen as foreign. Dysregulated immune cells can secrete inflammatory cytokines that cause systemic inflammation or they can recognize self-antigens as foreign.

Examples of autoimmune diseases include: Autoimmune hepatitis, Multiple Sclerosis, Myasthenia Gravis, Type I diabetes, Rheumatoid Arthritis, Psoriasis, Systemic Lupus Erythematosis, Hashimoto's Thyroiditis, Grave's disease, Ankylosing Spondylitis Sjogrens Disease, CREST syndrome, Scleroderma and many more.

Most of the autoimmune diseases are also chronic inflammatory diseases. This is defined as a disease process associated with long-term (>6 months) activation of inflammatory cells (leukocytes). The chronic inflammation leads to damage of patient organs or tissues. Many diseases are chronic inflammatory disorders, but are not know to have an autoimmune basis. For example, Atherosclerosis, Congestive Heart Failure, Crohn's disease, Ulcerative Colitis, Polyarteritis nodosa, Whipple's Disease, Primary Sclerosing Cholangitis and many more.

The terms "molecular signature" or "expression profile" refers to the collection of expression values for a plurality (e.g., at least 2, but frequently about 10, about 100, about 1000, or more) of members of a candidate library. In many cases, the molecular signature represents the expression pattern for all of the nucleotide sequences in a library or array of candidate or diagnostic nucleotide sequences or genes. Alternatively, the molecular signature represents the expression pattern for one or more subsets of the candidate library. The term "oligonucleotide" refers to two or more nucleotides. Nucleotides may be DNA or RNA, naturally occurring or synthetic.

The term "healthy individual," as used herein, is relative to a specified disease or disease criterion. That is, the individual does not exhibit the specified disease criterion or is not diagnosed with the specified disease. It will be understood, that the individual in question, can, of course, exhibit symptoms, or possess various indicator factors for another disease.

Similarly, an "individual diagnosed with a disease" refers to an individual diagnosed with a specified disease (or disease criterion). Such an individual may, or may not, also exhibit a disease criterion associated with, or be diagnosed with another (related or unrelated) disease.

The term "monitoring" is used herein to describe the use of gene sets to provide useful information about an individual or an individual's health or disease status. "Monitoring" can include, determination of prognosis, risk-stratification, selection of drug therapy, assessment of ongoing drug therapy, prediction of outcomes, determining response to therapy, diagnosis of a disease or disease complication, following progression of a disease or providing any information relating to a patients health status.

An "array" is a spatially or logically organized collection, e.g., of oligonucleotide sequences or nucleotide sequence products such as RNA or proteins encoded by an oligonucleotide sequence. In some embodiments, an array includes antibodies or other binding reagents specific for products of a candidate library.

When referring to a pattern of expression, a "qualitative" difference in gene expression refers to a difference that is not assigned a relative value. That is, such a difference is designated by an "all or nothing" valuation. Such an all or nothing variation can be, for example, expression above or below a threshold of detection (an on/off pattern of expression). Alternatively, a qualitative difference can refer to expression of different types of expression products, e.g., different alleles (e.g., a mutant or polymorphic allele), variants (including sequence variants as well as post-translationally modified variants), etc.

In contrast, a "quantitative" difference, when referring to a pattern of gene expression, refers to a difference in expression that can be assigned a value on a graduated scale, (e.g., a 0-5 or 1-10 scale, a +–+++ scale, a grade 1-grade 5 scale, or the like; it will be understood that the numbers selected for illustration are entirely arbitrary and in no-way are meant to be interpreted to limit the invention).

Gene Expression Systems and Methods of Detecting Gene Expression

The invention is directed to methods of detecting gene expression with a gene expression system having one or more DNA molecules wherein the one or more DNA molecules has a nucleotide sequence which detects expression of a gene corresponding to the oligonucleotides depicted in the Sequence Listing. In one format, the oligonucleotide detects expression of a gene that is differentially expressed in leukocytes. The gene expression system may be a candidate library, a diagnostic agent, a diagnostic oligonucleotide set or a diagnostic probe set. The DNA molecules may be genomic DNA, RNA, protein nucleic acid (PNA), cDNA or synthetic oligonucleotides. Following the procedures taught herein, one can identity sequences of interest for analyzing gene expression in leukocytes. Such sequences may be predictive of a disease state.

Diagnostic Oligonucleotides of the Invention

The invention relates to diagnostic oligonucleotides and diagnostic oligonucleotide set(s) comprising members of the leukocyte candidate library listed in Table 2, Table 3 and Tables 8-10 in the Sequence Listing, for which a correlation exists between the health status of an individual, and the individual's expression of RNA or protein products corresponding to the nucleotide sequence. In some instances, only one oligonucleotide is necessary for such detection. Members of a diagnostic oligonucleotide set may be identified by any means capable of detecting expression of RNA or protein products, including but not limited to differential expression screening, PCR, RT-PCR, SAGE analysis, high-throughput sequencing, microarrays, liquid or other arrays, protein-based methods (e.g., western blotting, proteomics, and other methods described herein), and data mining methods, as further described herein.

In one embodiment, a diagnostic oligonucleotide set comprises at least two oligonucleotide sequences listed in Table 2, Table 3 and Tables 8-10 or the Sequence Listing which are differentially expressed in leukocytes in an individual with at least one disease criterion for at least one leukocyte-implicated disease relative to the expression in individual without the at least one disease criterion, wherein expression of the two or more nucleotide sequences is correlated with at least one disease criterion, as described below.

In another embodiment, a diagnostic oligonucleotide set comprises at least one oligonucleotide having an oligonucleotide sequence listed in Table 2, 3 and Tables 8-10, or the Sequence Listing which is differentially expressed, and further wherein the differential expression/correlation has not previously been described. In some embodiments, the diagnostic oligonucleotide set is immobilized on an array.

In another embodiment, diagnostic oligonucleotides (or oligonucleotide sets) are related to the members of the leukocyte candidate library listed in Table 2, Table 3, Tables 8-10 and in the Sequence Listing, for which a correlation exists between the health status (or disease criterion) of an individual. The diagnostic oligonucleotides are partially or totally contained in (or derived from) full-length gene sequences (or predicted full-length gene sequences) for the members of the candidate library listed in Table 2, 3 and the Sequence Listing. This includes sequences from accession numbers and unigene numbers from Table 8. Table 8 shows the accession and unigene number (when known) for each oligonucleotide used on the 8134 gene leukocyte array described in examples 11-13. In some cases, oligonucleotide sequences are designed from EST or Chromosomal sequences from a public database. In these cases the full-length gene sequences may not be known. Full-length sequences in these cases can be predicted using gene prediction algorithms (Examples 4-6). Alternatively the full-length can be determined by cloning and sequencing the full-length gene or genes that contain the sequence of interest using standard molecular biology approaches described here. The same is true for olignonucleotides designed from our sequencing of cDNA libraries (see Examples 1-4) where the cDNA does not match any sequence in the public databases.

The diagnostic oligonucleotides may also be derived from other genes that are coexpressed with the correlated sequence or full-length gene. Genes may share expression patterns because they are regulated in the same molecular pathway. Because of the similarity of expression, behavior genes are identified as surrogates in that they can substitute for a diagnostic gene in a diagnostic gene set. Example 10 demonstrates the discovery of surrogates from the data and Table 10C and the sequence listing identify and give the sequence for surrogates for lupus diagnostic genes. Surrogate oligonucleotide and surrogate oligonucleotide sets can be utilized to detect expression of surrogate genes and thereby diagnose or monitor patients with a disease.

As used herein the term "gene cluster" or "cluster" refers to a group of genes related by expression pattern. In other words, a cluster of genes is a group of genes with similar regulation across different conditions, such as a patient having a chronic autoimmune or inflammatory disease or a patient without chronic autoimmune or inflammatory disease. The expression profile for each gene in a cluster should be correlated with the expression profile of at least one other gene in that cluster. Correlation may be evaluated using a variety of statistical methods. As used herein the term "surrogate" refers to a gene with an expression profile such that it can substitute for a diagnostic gene in a diagnostic assay. Such genes are often members of the same gene cluster as the diagnostic gene. For each member of a diagnostic gene set, a set of potential surrogates can be identified through identification of genes with similar expression patterns as described below.

Many statistical analyses produce a correlation coefficient to describe the relatedness between two gene expression patterns. Patterns may be considered correlated if the correlation coefficient is greater than or equal to 0.8. In preferred embodiments, the correlation coefficient should be greater than 0.85, 0.9 or 0.95. Other statistical methods produce a measure of mutual information to describe the relatedness between two gene expression patterns. Patterns may be considered correlated if the normalized mutual information value is greater than or equal to 0.7. In preferred embodiments, the normalized mutual information value should be greater than 0.8, 0.9 or 0.95. Patterns may also be considered similar if they cluster closely upon hierarchical clustering of gene expression data (Eisen et al. 1998). Similar patterns may be those genes that are among the 1, 2, 5, 10, 20, 50 or 100 nearest neighbors in a hierarchical clustering or have a similarity score (Eisen et al. 1998) of >0.5, 0.7, 0.8, 0.9, 0.95 or 0.99. Similar patterns may also be identified as those genes found to be surrogates in a classification tree by CART (Breiman et al. 1994). Often, but not always, members of a gene cluster have similar biological functions in addition to similar gene expression patterns.

Correlated genes, clusters and surrogates are identified for the diagnostic genes of the invention. These surrogates may be used as diagnostic genes in an assay instead of, or in addition to, the diagnostic genes for which they are surrogates.

The invention also provides diagnostic probe sets. It is understood that a probe includes any reagent capable of specifically identifying a nucleotide sequence of the diagnostic nucleotide set, including but not limited to amplified DNA, amplified RNA, cDNA, synthetic oligonucleotide, partial or full-length nucleic acid sequences. In addition, the probe may identify the protein product of a diagnostic nucleotide sequence, including, for example, antibodies and other affinity reagents.

It is also understood that each probe can correspond to one gene, or multiple probes can correspond to one gene, or both, or one probe can correspond to more than one gene.

Homologs and variants of the disclosed nucleic acid molecules may be used in the present invention. Homologs and variants of these nucleic acid molecules will possess a relatively high degree of sequence identity when aligned using standard methods. The sequences encompassed by the invention have at least 40-50, 50-60, 70-80, 80-85, 85-90, 90-95 or 95-100% sequence identity to the sequences disclosed herein.

It is understood that for expression profiling, variations in the disclosed sequences will still permit detection of gene expression. The degree of sequence identity required to detect gene expression varies depending on the length of the oligomer. For a 60 mer, (an oligonucleotide with 60 nucleotides) 6-8 random mutations or 6-8 random deletions in a 60 mer do not affect gene expression detection. Hughes, T R, et al. "Expression profiling using microarrays fabricated by an ink-jet oligonucleotide synthesizer. Nature Biotechnology, 19:343-347(2001). As the length of the DNA sequence is increased, the number of mutations or deletions permitted while still allowing gene expression detection is increased.

As will be appreciated by those skilled in the art, the sequences of the present invention may contain sequencing errors. That is, there may be incorrect nucleotides, frameshifts, unknown nucleotides, or other types of sequencing errors in any of the sequences; however, the correct sequences will fall within the homology and stringency definitions herein.

The minimum length of an oligonucleotide probe necessary for specific hybridization in the human genome can be estimated using two approaches. The first method uses a statistical argument that the probe will be unique in the human genome by chance. Briefly, the number of independent perfect matches (Po) expected for an oligonucleotide of length L in a genome of complexity C can be calculated from the equation (Laird C D, Chromosoma 32:378 (1971):

$$Po = (1/4)^L * 2C$$

In the case of mammalian genomes, $2C = \sim 3.6 \times 10^9$, and an oligonucleotide of 14-15 nucleotides is expected to be represented only once in the genome. However, the distribution of nucleotides in the coding sequence of mammalian genomes is nonrandom (Lathe, R. J. Mol. Biol. 183:1 (1985) and longer oligonucleotides may be preferred in order to in increase the specificity of hybridization. In practical terms, this works out to probes that are 19-40 nucleotides long (Sambrook J et al., infra). The second method for estimating the length of a specific probe is to use a probe long enough to hybridize under the chosen conditions and use a computer to search for that sequence or close matches to the sequence in the human genome and choose a unique match. Probe sequences are chosen based on the desired hybridization properties as described in Chapter 11 of Sambrook et al, infra. The PRIMER3 program is useful for designing these probes (S. Rozen and H. Skaletsky 1996, 1997; Primer3 code available at genome.wi.mit.edu/genome_software/other/primer3.html, the website). The sequences of these probes are then compared pair wise against a database of the human genome sequences using a program such as BLAST or MEGABLAST (Madden, T. L et al. (1996) Meth. Enzymol. 266:131-141). Since most of the human genome is now contained in the database, the number of matches will be determined. Probe sequences are chosen that are unique to the desired target sequence.

In some embodiments, a diagnostic oligonucleotide or oligonucleotide probe set is immobilized on an array. The array is optionally comprises one or more of: a chip array, a plate array, a bead array, a pin array, a membrane array, a solid surface array, a liquid array, an oligonucleotide array, a polynucleotide array or a cDNA array, a microtiter plate, a pin array, a bead array, a membrane or a chip.

In some embodiments, the leukocyte-implicated disease is selected from the diseases listed in Table 1. In other embodiments, the disease is atherosclerosis or cardiac allograft rejection. In other embodiments, the disease is congestive heart failure, angina, myocardial infarction, chronic autoimmune and inflammatory diseases, systemic lupus erythematosis (SLE) and rheumatoid arthritis.

In some embodiments, diagnostic oligonucleotides of the invention are used as a diagnostic gene set in combination with genes that are know to be associated with a disease state ("known markers"). The use of the diagnostic oligonucleotides in combination with the known markers can provide information that is not obtainable through the known markers alone. The known markers include those identified by the prior art listing provided.

General Molecular Biology References

In the context of the invention, nucleic acids and/or proteins are manipulated according to well known molecular biology techniques. Detailed protocols for numerous such procedures are described in, e.g., in Ausubel et al. *Current Protocols in Molecular Biology* (supplemented through 2000) John Wiley & Sons, New York ("Ausubel"); Sambrook et al. *Molecular Cloning—A Laboratory Manual* (2nd Ed.), Vol. 1-3, Cold Spring Harbor Laboratory, Cold Spring Harbor, N.Y., 1989 ("Sambrook"), and Berger and Kimmel *Guide to Molecular Cloning Techniques, Methods in Enzymology* volume 152 Academic Press, Inc., San Diego, Calif. ("Berger").

In addition to the above references, protocols for in vitro amplification techniques, such as the polymerase chain reaction (PCR), the ligase chain reaction (LCR), Q-replicase amplification, and other RNA polymerase mediated techniques (e.g., NASBA), useful e.g., for amplifying cDNA probes of the invention, are found in Mullis et al. (1987) U.S. Pat. No. 4,683,202; *PCR Protocols A Guide to Methods and Applications* (Innis et al. eds) Academic Press Inc. San Diego, Calif. (1990) ("Innis"); Arnheim and Levinson (1990) *C&EN* 36; *The Journal Of NIH Research* (1991) 3:81; Kwoh et al. (1989) *Proc Natl Acad Sci USA* 86, 1173; Guatelli et al. (1990) *Proc Natl Acad Sci USA* 87:1874; Lomell et al. (1989) *J Clin Chem* 35:1826; Landegren et al. (1988) *Science* 241: 1077; Van Brunt (1990) *Biotechnology* 8:291; Wu and Wallace (1989) *Gene* 4: 560; Barringer et al. (1990) *Gene* 89:117, and Sooknanan and Malek (1995) *Biotechnology* 13:563. Additional methods, useful for cloning nucleic acids in the context of the present invention, include Wallace et al. U.S. Pat. No. 5,426,039. Improved methods of amplifying large nucleic acids by PCR are summarized in Cheng et al. (1994) *Nature* 369:684 and the references therein.

Certain polynucleotides of the invention, e.g., oligonucleotides can be synthesized utilizing various solid-phase strategies involving mononucleotide- and/or trinucleotide-based phosphoramidite coupling chemistry. For example, nucleic acid sequences can be synthesized by the sequential addition of activated monomers and/or trimers to an elongating polynucleotide chain. See e.g., Caruthers, M. H. et al. (1992) *Meth Enzmmol* 211:3.

In lieu of synthesizing the desired sequences, essentially any nucleic acid can be custom ordered from any of a variety of commercial sources, such as The Midland Certified Reagent Company (mcrc@oligos.com), The Great American Gene Company (genco.com), ExpressGen, Inc. (expressgen. com), Operon Technologies, Inc. (operon.com), and many others.

Similarly, commercial sources for nucleic acid and protein microarrays are available, and include, e.g., Agilent Technologies, Palo Alto, Calif. and Affymetrix, Santa Clara, Calif.

Candidate Library

Libraries of candidate genes that are differentially expressed in leukocytes are substrates for the identification and evaluation of diagnostic oligonucleotides and oligonucleotide sets and disease specific target nucleotide sequences.

The term leukocyte is used generically to refer to any nucleated blood cell that is not a nucleated erythrocyte. More specifically, leukocytes can be subdivided into two broad classes. The first class includes granulocytes, including, most prevalently, neutrophils, as well as eosinophils and basophils at low frequency. The second class, the non-granular or mononuclear leukocytes, includes monocytes and lymphocytes (e.g., T cells and B cells). There is an extensive literature in the art implicating leukocytes, e.g., neutrophils, monocytes and lymphocytes in a wide variety of disease processes, including inflammatory and rheumatic diseases, neurodegenerative diseases (such as Alzheimer's dementia), cardiovascular disease, endocrine diseases, transplant rejection, malignancy and infectious diseases, and other diseases listed in Table 1. Mononuclear cells are involved in the chronic immune response, while granulocytes, which make up approximately 60% of the leukocytes, have a non-specific and stereotyped response to acute inflammatory stimuli and often have a life span of only 24 hours.

In addition to their widespread involvement and/or implication in numerous disease related processes, leukocytes are particularly attractive substrates for clinical and experimental evaluation for a variety of reasons. Most importantly, they are readily accessible at low cost from essentially every potential subject. Collection is minimally invasive and associated with little pain, disability or recovery time. Collection can be performed by minimally trained personnel (e.g., phlebotomists, medical technicians, etc.) in a variety of clinical and non-clinical settings without significant technological expenditure. Additionally, leukocytes are renewable, and thus available at multiple time points for a single subject.

Assembly of Candidate Libraries

At least two conceptually distinct approaches to the assembly of candidate libraries exist. Either, or both, or other, approaches can be favorably employed. The method of assembling, or identifying, candidate libraries is secondary to the criteria utilized for selecting appropriate library members. Most importantly, library members are assembled based on differential expression of RNA or protein products in leukocyte populations. More specifically, candidate nucleotide sequences are induced or suppressed, or expressed at increased or decreased levels in leukocytes from a subject with one or more disease or disease state (a disease criterion) relative to leukocytes from a subject lacking the specified disease criterion. Alternatively, or in addition, library members can be assembled from among nucleotide sequences that are differentially expressed in activated or resting leukocytes relative to other cell types.

Firstly, publication and sequence databases can be "mined" using a variety of search strategies. For example, currently available scientific and medical publication databases such as Medline, Current Contents, OMIM (online Mendelian inheritance in man) various Biological and Chemical Abstracts, Journal indexes, and the like can be searched using term or key-word searches, or by author, title, or other relevant search parameters. Many such databases are publicly available, and one of skill is well versed in strategies and procedures for identifying publications and their contents, e.g., genes, other nucleotide sequences, descriptions, indications, expression pattern, etc. Numerous databases are available through the internet for free or by subscription, see, e.g., the websites, ncbi.nlm.nih.gov/PubMed/; 3.infotrieve. com/; isinet.com/; sciencemag.org/. Additional or alternative publication or citation databases are also available that provide identical or similar types of information, any of which are favorably employed in the context of the invention. These databases can be searched for publications describing differential gene expression in leukocytes between patients with and without diseases or conditions listed in Table 1. We identified the nucleotide sequences listed in Table 2 and some of the sequences used to design oligonucleotides for microarrays (sequence listing), using data mining methods.

Alternatively, a variety of publicly available and proprietary sequence databases (including GenBank, dbEST, UniGene, and TIGR and SAGE databases) including sequences corresponding to expressed nucleotide sequences, such as expressed sequence tags (ESTs) are available. For example, the Genbank™ website located at ncbi.nlm.nih.gov/Genbank/among others, can be readily accessed and searched via the internet. These and other sequence and clone database resources are currently available; however, any number of additional or alternative databases comprising nucleotide sequence sequences, EST sequences, clone repositories, PCR primer sequences, and the like corresponding to individual nucleotide sequence sequences are also suitable for the purposes of the invention. Nucleotide sequences can be identified that are only found in libraries derived from leukocytes or sub-populations of leukocytes, for example see Table 2 and Example 2.

Alternatively, the representation, or relative frequency, of a nucleotide sequence may be determined in a leukocyte-derived nucleic acid library and compared to the representation of the sequence in non-leukocyte derived libraries. The representation of a nucleotide sequence correlates with the relative expression level of the nucleotide sequence in leukocytes and non-leukocytes. An oligonucleotide sequence that has increased or decreased representation in a leukocyte-derived nucleic acid library relative to a non-leukocyte-derived libraries is a candidate for a leukocyte-specific gene.

Nucleotide sequences identified as having specificity to activated or resting leukocytes or to leukocytes from patients or patient samples with a variety of disease types can be isolated for use in a candidate library for leukocyte expression profiling through a variety of mechanisms. These include, but are not limited to, the amplification of the nucleotide sequence from RNA or DNA using nucleotide sequence specific primers for PCR or RT-PCR, isolation of the nucleotide sequence using conventional cloning methods, the purchase of an IMAGE consortium cDNA clone (EST) with complimentary sequence or from the same expressed nucleotide sequence, design of oligonucleotides, preparation of synthetic nucleic acid sequence, or any other nucleic-acid based method. In addition, the protein product of the nucleotide sequence can be isolated or prepared, and represented in a candidate library, using standard methods in the art, as described further below.

While the above discussion related primarily to "genomics" approaches, it is appreciated that numerous, analogous "proteomics" approaches are suitable to the present invention. For example, a differentially expressed protein product can, for example, be detected using western analysis, two-dimensional gel analysis, chromatographic separation, mass spectrometric detection, protein-fusion reporter constructs, colorometric assays, binding to a protein array, or by characterization of polysomal mRNA. The protein is further characterized and the nucleotide sequence encoding the protein is identified using standard techniques, e.g. by screening a cDNA library using a probe based on protein sequence information.

The second approach involves the construction of a differential expression library by any of a variety of means. Any one or more of differential screening, differential display or subtractive hybridization procedures, or other techniques that preferentially identify, isolate or amplify differentially expressed nucleotide sequences can be employed to produce a library of differentially expressed candidate nucleotide sequences, a subset of such a library, a partial library, or the like. Such methods are well known in the art. For example, peripheral blood leukocytes, (i.e., a mixed population including lymphocytes, monocytes and neutrophils), from multiple donor samples are pooled to prevent bias due to a single-donor's unique genotype. The pooled leukocytes are cultured in standard medium and stimulated with individual cytokines or growth factors e.g., with IL-2, IL-1, MCP1, TNFα and/or IL8 according to well known procedures (see, e.g., Tough et al. (1999); Winston et al. (1999); Hansson et al. (1989)). Typically, leukocytes are recovered from Buffy coat preparations produced by centrifugation of whole blood. Alternatively, mononuclear cells (monocytes and lymphocytes) can be obtained by density gradient centrifugation of whole blood, or specific cell types (such as a T lymphocyte) can be isolated using affinity reagents to cell specific surface markers. When affinity reagents are used to isolate specific cell types, it is desirable to isolate the cells using negative selection to avoid activation of the desired cell type by binding of the antibody. Leukocytes may also be stimulated by incubation with ionomycin, and phorbol myristate acetate (PMA). This stimulation protocol is intended to non-specifically mimic "activation" of numerous pathways due to variety of disease conditions rather than to simulate any single disease condition or paradigm.

Using well-known subtractive hybridization procedures (as described in, e.g., U.S. Pat. Nos. 5,958,738; 5,589,339; 5,827,658; 5,712,127; 5,643,761) each of which are hereby incorporated by reference, a library is produced that is enriched for RNA species (messages) that are differentially expressed between test and control leukocyte populations. In some embodiments, the test population of leukocytes are simply stimulated as described above to emulate non-specific activation events, while in other embodiments the test population can be selected from subjects (or patients) with a specified disease or class of diseases. Typically, the control leukocyte population lacks the defining test condition, e.g., stimulation, disease state, diagnosis, genotype, etc. Alternatively, the total RNA from control and test leukocyte populations are prepared by established techniques, treated with DNAseI, and selected for messenger RNA with an intact 3' end (i.e., polyA(+) messenger RNA) e.g., using commercially available kits according to the manufacturer's instructions e.g. Clontech. Double stranded cDNA is synthesized utilizing reverse transcriptase. Double stranded cDNA is then cut with a first restriction enzyme (e.g., NlaIII, that cuts at the recognition site: CATG, and cuts the cDNA sequence at approximately 256 bp intervals) that cuts the cDNA molecules into conveniently sized fragments.

The cDNAs prepared from the test population of leukocytes are divided into (typically 2) "tester" pools, while cDNAs prepared from the control population of leukocytes are designated the "driver" pool. Typically, pooled populations of cells from multiple individual donors are utilized and in the case of stimulated versus unstimulated cells, the corresponding tester and driver pools for any single subtraction reaction are derived from the same donor pool.

A unique double-stranded adapter is ligated to each of the tester cDNA populations using unphosphorylated primers so that only the sense strand is covalently linked to the adapter. An initial hybridization is performed consisting of each of the tester pools of cDNA (each with its corresponding adapter) and an excess of the driver cDNA. Typically, an excess of about 10-100 fold driver relative to tester is employed, although significantly lower or higher ratios can be empirically determined to provide more favorable results. The initial hybridization results in an initial normalization of the cDNAs such that high and low abundance messages become more equally represented following hybridization due to a failure of driver/tester hybrids to amplify.

A second hybridization involves pooling un-hybridized sequences from initial hybridizations together with the addition of supplemental driver cDNA. In this step, the expressed sequences enriched in the two tester pools following the initial hybridization can hybridize. Hybrids resulting from the hybridization between members of each of the two tester pools are then recovered by amplification in a polymerase chain reaction (PCR) using primers specific for the unique adapters. Again, sequences originating in a tester pool that form hybrids with components of the driver pool are not amplified. Hybrids resulting between members of the same tester pool are eliminated by the formation of "panhandles" between their common 5' and 3' ends. For additional details, see, e.g., Lukyanov et al. (1997) Biochem Biophys Res Commun 230:285-8.

Typically, the tester and driver pools are designated in the alternative, such that the hybridization is performed in both directions to ensure recovery of messenger RNAs that are differentially expressed in either a positive or negative manner (i.e., that are turned on or turned off, up-regulated or down-regulated). Accordingly, it will be understood that the designation of test and control populations is to some extent arbitrary, and that a test population can just as easily be compared to leukocytes derived from a patient with the same of another disease of interest.

If so desired, the efficacy of the process can be assessed by such techniques as semi-quantitative PCR of known (i.e., control) nucleotide sequences, of varying abundance such as β-actin. The resulting PCR products representing partial cDNAs of differentially expressed nucleotide sequences are then cloned (i.e., ligated) into an appropriate vector (e.g., a commercially available TA cloning vector, such as pGEM from Promega) and, optionally, transformed into competent bacteria for selection and screening.

Either of the above approaches, or both in combination, or indeed, any procedure, which permits the assembly of a collection of nucleotide sequences that are expressed in leukocytes, is favorably employed to produce the libraries of candidates useful for the identification of diagnostic nucleotide sets and disease specific target nucleotides of the invention. Additionally, any method that permits the assembly of a collection of nucleotides that are expressed in leukocytes and preferentially associated with one or more disease or condition, whether or not the nucleotide sequences are differentially expressed, is favorably employed in the context of the invention. Typically, libraries of about 2,000 members are produced (although libraries in excess of 10,000 are not uncommon). Following additional evaluation procedures, as described below, the proportion of unique clones in the candidate library can approximate 100%.

A candidate oligonucleotide sequence may be represented in a candidate library by a full-length or partial nucleic acid sequence, deoxyribonucleic acid (DNA) sequence, cDNA sequence, RNA sequence, synthetic oligonucleotides, etc. The nucleic acid sequence can be at least 19 nucleotides in length, at least 25 nucleotides, at least 40 nucleotides, at least 100 nucleotides, or larger. Alternatively, the protein product of a candidate nucleotide sequence may be represented in a candidate library using standard methods, as further described below.

Characterization of Candidate Oligonucleotide Sequences

The sequence of individual members (e.g., clones, partial sequence listing in a database such as an EST, etc.) of the candidate oligonucleotide libraries is then determined by conventional sequencing methods well known in the art, e.g., by the dideoxy-chain termination method of Sanger et al. (1977) Proc Natl Acad Sci USA 74:5463-7; by chemical procedures, e.g., Maxam and Gilbert (1977) Proc Natl Acad Sci USA 74:560-4; or by polymerase chain reaction cycle sequencing methods, e.g., Olsen and Eckstein (1989) Nuc Acid Res 17:9613-20, DNA chip based sequencing techniques or variations, including automated variations (e.g., as described in Hunkapiller et al. (1991) Science 254:59-67; Pease et al. (1994) Proc Natl Acad Sci USA 91:5022-6), thereof. Numerous kits for performing the above procedures are commercially available and well known to those of skill in the art. Character strings corresponding to the resulting nucleotide sequences are then recorded (i.e., stored) in a database. Most commonly the character strings are recorded on a computer readable medium for processing by a computational device.

Generally, to facilitate subsequent analysis, a custom algorithm is employed to query existing databases in an ongoing fashion, to determine the identity, expression pattern and potential function of the particular members of a candidate library. The sequence is first processed, by removing low quality sequence. Next the vector sequences are identified and removed and sequence repeats are identified and masked. The remaining sequence is then used in a Blast algorithm against multiple publicly available, and/or proprietary databases, e.g., NCBI nucleotide, EST and protein databases, Unigene, and Human Genome Sequence. Sequences are also compared to all previously sequenced members of the candidate libraries to detect redundancy.

In some cases, sequences are of high quality, but do not match any sequence in the NCBI nr, human EST or Unigene databases. In this case the sequence is queried against the human genomic sequence. If a single chromosomal site is matched with a high degree of confidence, that region of genomic DNA is identified and subjected to further analysis with a gene prediction program such as GRAIL. This analysis may lead to the identification of a new gene in the genomic sequence. This sequence can then be translated to identify the protein sequence that is encoded and that sequence can be further analyzed using tools such as Pfam, Blast P, or other protein structure prediction programs, as illustrated in Table 7. Typically, the above analysis is directed towards the identification of putative coding regions, e.g., previously unidentified open reading frames, confirming the presence of known coding sequences, and determining structural motifs or sequence similarities of the predicted protein (i.e., the conceptual translation product) in relation to known sequences. In addition, it has become increasingly possible to assemble "virtual cDNAs" containing large portions of coding region, simply through the assembly of available expressed sequence tags (ESTs). In turn, these extended nucleic acid and amino acid sequences allow the rapid expansion of substrate sequences for homology searches and structural and functional motif characterization. The results of these analysis permits the categorization of sequences according to structural characteristics, e.g., as structural proteins, proteins involved in signal transduction, cell surface or secreted proteins etc.

It is understood that full-length nucleotide sequences may also be identified using conventional methods, for example, library screening, RT-PCR, chromosome walking, etc., as described in Sambrook and Ausubel, infra.

Candidate Nucleotide Library of the Invention

We identified members of a candidate nucleotide library that are differentially expressed in activated leukocytes and resting leukocytes. Accordingly, the invention provides the candidate leukocyte nucleotide library comprising the nucleotide sequences listed in Table 2, Table 3, Tables 8-10 and in the Sequence Listing. In another embodiment, the invention provides a candidate library comprising at least two nucleotide sequences listed in Table 2, Table 3, Tables 8-10 and the Sequence Listing. In another embodiment, at least two nucleotide sequences are 18 nucleotides in length, at least 35 nucleotides, at least 40 nucleotides or at least 100 nucleotides. In some embodiments, the nucleotide sequences comprises deoxyribonucleic acid (DNA) sequence, ribonucleic acid (RNA) sequence, synthetic oligonucleotide sequence, or genomic DNA sequence. It is understood that the nucleotide sequences may each correspond to one gene, or that several nucleotide sequences may correspond to one gene, or that a single nucleotide sequence may correspond to multiple genes.

The invention also provides probes to the candidate nucleotide library. In one embodiment of the invention, the probes comprise at least two nucleotide sequences listed in Table 2, Table 3, Tables 8-10, or the Sequence Listing which are differentially expressed in leukocytes in an individual with a least one disease criterion for at least one leukocyte-related disease and in leukocytes in an individual without the at least one disease criterion, wherein expression of the two or more nucleotide sequences is correlated with at least one disease criterion. It is understood that a probe may detect either the RNA expression or protein product expression of the candidate nucleotide-library. Alternatively, or in addition, a probe can detect a genotype associated with a candidate nucleotide sequence, as further described below. In another embodiment, the probes for the candidate nucleotide library are immobilized on an array.

The candidate nucleotide library of the invention is useful in identifying diagnostic nucleotide sets of the invention, as described below. The candidate nucleotide sequences may be further characterized, and may be identified as a disease target nucleotide sequence and/or a novel nucleotide sequence, as described below. The candidate nucleotide sequences may also be suitable for use as imaging reagents, as described below.

Generation of Expression Patterns

RNA, DNA or Protein Sample Procurement

Following identification or assembly of a library of differentially expressed candidate nucleotide sequences, leukocyte expression profiles corresponding to multiple members of the candidate library are obtained. Leukocyte samples from one or more subjects are obtained by standard methods. Most typically, these methods involve transcutaneous venous sampling of peripheral blood. While sampling of circulating leukocytes from whole blood from the peripheral vasculature is generally the simplest, least invasive, and lowest cost alternative, it will be appreciated that numerous alternative sampling procedures exist, and are favorably employed in some circumstances. No pertinent distinction exists, in fact, between leukocytes sampled from the peripheral vasculature, and those obtained, e.g., from a central line, from a central artery, or indeed from a cardiac catheter, or during a surgical procedure which accesses the central vasculature. In addition, other body fluids and tissues that are, at least in part, composed of leukocytes are also desirable leukocyte samples. For example, fluid samples obtained from the lung during bronchoscopy may be rich in leukocytes, and amenable to expression profiling in the context of the invention, e.g., for the diagnosis, prognosis, or monitoring of lung transplant rejection, inflammatory lung diseases or infectious lung disease. Fluid samples from other tissues, e.g., obtained by endoscopy of the colon, sinuses, esophagus, stomach, small bowel, pancreatic duct, biliary tree, bladder, ureter, vagina, cervix or uterus, etc., are also suitable. Samples may also be obtained other sources containing leukocytes, e.g., from urine, bile, cerebrospinal fluid, feces, gastric or intestinal secretions, semen, or solid organ or joint biopsies.

Most frequently, mixed populations of leukocytes, such as are found in whole blood are utilized in the methods of the present invention. A crude separation, e.g., of mixed leukocytes from red blood cells, and/or concentration, e.g., over a sucrose, percoll or ficoll gradient, or by other methods known in the art, can be employed to facilitate the recovery of RNA or protein expression products at sufficient concentrations, and to reduce non-specific background. In some instances, it can be desirable to purify sub-populations of leukocytes, and methods for doing so, such as density or affinity gradients, flow cytometry, Fluorescence Activated Cell Sorting (FACS), immuno-magnetic separation, "panning," and the like, are described in the available literature and below.

Obtaining DNA, RNA and Protein Samples for Expression Profiling

A variety of techniques are available for the isolation of RNA from whole blood. Any technique that allows isolation of mRNA from cells (in the presence or absence of rRNA and tRNA) can be utilized. In brief, one method that allows reliable isolation of total RNA suitable for subsequent gene expression analysis is described as follows. Peripheral blood (either venous or arterial) is drawn from a subject, into one or more sterile, endotoxin free, tubes containing an anticoagulant (e.g., EDTA, citrate, heparin, etc.). Typically, the sample is divided into at least two portions. One portion, e.g., of 5-8 ml of whole blood is frozen and stored for future analysis, e.g., of DNA or protein. A second portion, e.g., of approximately 8 ml whole blood is processed for isolation of total RNA by any of a variety of techniques as described in, e.g, Sambook, Ausubel, below, as well as U.S. Pat. Nos. 5,728, 822 and 4,843,155.

Typically, a subject sample of mononuclear leukocytes obtained from about 8 ml of whole blood, a quantity readily available from an adult human subject under most circumstances, yields 5-20 μg of total RNA. This amount is ample, e.g., for labeling and hybridization to at least two probe arrays. Labeled probes for analysis of expression patterns of nucleotides of the candidate libraries are prepared from the subject's sample of RNA using standard methods. In many cases, cDNA is synthesized from total RNA using a polyT primer and labeled, e.g., radioactive or fluorescent, nucleotides. The resulting labeled cDNA is then hybridized to probes corresponding to members of the candidate nucleotide library, and expression data is obtained for each nucleotide sequence in the library. RNA isolated from subject samples (e.g., peripheral blood leukocytes, or leukocytes obtained from other biological fluids and samples) is next used for analysis of expression patterns of nucleotides of the candidate libraries.

In some cases, however, the amount of RNA that is extracted from the leukocyte sample is limiting, and amplification of the RNA is desirable. Amplification may be accomplished by increasing the efficiency of probe labeling, or by amplifying the RNA sample prior to labeling. It is appreciated that care must be taken to select an amplification procedure that does not introduce any bias (with respect to gene expression levels) during the amplification process.

Several methods are available that increase the signal from limiting amounts of RNA, e.g. use of the Clontech (Glass Fluorescent Labeling Kit) or Stratagene (Fairplay Microarray Labeling Kit), or the Micromax kit (New England Nuclear, Inc.). Alternatively, cDNA is synthesized from RNA using a T7-polyT primer, in the absence of label, and DNA dendrimers from Genisphere (3DNA Submicro) are hybridized to the poly T sequence on the primer, or to a different "capture sequence" which is complementary to a fluorescently labeled sequence. Each 3DNA molecule has 250 fluorescent molecules and therefore can strongly label each cDNA.

Alternatively, the RNA sample is amplified prior to labeling. For example, linear amplification may be performed, as described in U.S. Pat. No. 6,132,997. A T7-polyT primer is used to generate the cDNA copy of the RNA. A second DNA strand is then made to complete the substrate for amplification. The T7 promoter incorporated into the primer is used by a T7 polymerase to produce numerous antisense copies of the original RNA. Fluorescent dye labeled nucleotides are directly incorporated into the RNA. Alternatively, amino allyl labeled nucleotides are incorporated into the RNA, and then fluorescent dyes are chemically coupled to the amino allyl groups, as described in Hughes et al. 2001. Other exemplary methods for amplification are described below.

It is appreciated that the RNA isolated must contain RNA derived from leukocytes, but may also contain RNA from other cell types to a variable degree. Additionally, the isolated RNA may come from subsets of leukocytes, e.g. monocytes and/or T-lymphocytes, as described above. Such consideration of cell type used for the derivation of RNA depends on the method of expression profiling used.

DNA samples may be obtained for analysis of the presence of DNA mutations, single nucleotide polymorphisms (SNPs), or other polymorphisms. DNA is isolated using standard techniques, e.g. Maniatus, supra.

Expression of products of candidate nucleotides may also be assessed using proteomics. Protein(s) are detected in samples of patient serum or from leukocyte cellular protein. Serum is prepared by centrifugation of whole blood, using standard methods. Proteins present in the serum may have been produced from any of a variety of leukocytes and non-leukocyte cells, and may include secreted proteins from leukocytes. Alternatively, leukocytes or a desired sub-population of leukocytes are prepared as described above. Cellular protein is prepared from leukocyte samples using methods well known in the art, e.g., Trizol (Invitrogen Life Technologies, cat # 15596108; Chomczynski, P. and Sacchi, N. (1987) Anal. Biochem. 162, 156; Simms, D., Cizdziel, P. E., and Chomczynski, P. (1993) Focus® 15, 99; Chomczynski, P., Bowers-Finn, R., and Sabatini, L. (1987) J. of NIH Res. 6, 83; Chomczynski, P. (1993) Bio/Techniques 15, 532; Bracete, A. M., Fox, D. K., and Simms, D. (1998) Focus 20, 82; Sewall, A. and McRae, S. (1998) Focus 20, 36; Anal Biochem 1984 April; 138(1):141-3, A method for the quantitative recovery of protein in dilute solution in the presence of detergents and lipids; Wessel D, Flugge U I. (1984) Anal Biochem. 1984 April; 138(1):141-143.

Obtaining Expression Patterns

Expression patterns, or profiles, of a plurality of nucleotides corresponding to members of the candidate library are then evaluated in one or more samples of leukocytes. Typically, the leukocytes are derived from patient peripheral blood samples, although, as indicated above, many other sample sources are also suitable. These expression patterns constitute a set of relative or absolute expression values for some number of RNAs or protein products corresponding to the plurality of nucleotide sequences evaluated, which is referred to herein as the subject's "expression profile" for those nucleotide sequences. While expression patterns for as few as one independent member of the candidate library can be obtained, it is generally preferable to obtain expression patterns corresponding to a larger number of nucleotide sequences, e.g., about 2, about 5, about 10, about 20, about 50, about 100, about 200, about 500, or about 1000, or more. The expression pattern for each differentially expressed component member of the library provides a finite specificity and sensitivity with respect to predictive value, e.g., for diagnosis, prognosis, monitoring, and the like.

Clinical Studies, Data and Patient Groups

For the purpose of discussion, the term subject, or subject sample of leukocytes, refers to an individual regardless of health and/or disease status. A subject can be a patient, a study participant, a control subject, a screening subject, or any other class of individual from whom a leukocyte sample is obtained and assessed in the context of the invention. Accordingly, a subject can be diagnosed with a disease, can present with one or more symptom of a disease, or a predisposing factor, such as a family (genetic) or medical history (medical) factor, for a disease, or the like. Alternatively, a subject can be healthy with respect to any of the aforementioned factors or criteria. It will be appreciated that the term "healthy" as used herein, is relative to a specified disease, or disease factor, or disease criterion, as the term "healthy" cannot be defined to correspond to any absolute evaluation or status. Thus, an individual defined as healthy with reference to any specified disease or disease criterion, can in fact be diagnosed with any other one or more disease, or exhibit any other one or more disease criterion.

Furthermore, while the discussion of the invention focuses, and is exemplified using human sequences and samples, the invention is equally applicable, through construction or selection of appropriate candidate libraries, to non-human animals, such as laboratory animals, e.g., mice, rats, guinea pigs, rabbits; domesticated livestock, e.g., cows, horses, goats, sheep, chicken, etc.; and companion animals, e.g., dogs, cats, etc.

Methods for Obtaining Expression Data

Numerous methods for obtaining expression data are known, and any one or more of these techniques, singly or in combination, are suitable for determining expression profiles in the context of the present invention. For example, expression patterns can be evaluated by northern analysis, PCR, RT-PCR, Taq Man analysis, FRET detection, monitoring one or more molecular beacon, hybridization to an oligonucleotide array, hybridization to a cDNA array, hybridization to a polynucleotide array, hybridization to a liquid microarray, hybridization to a microelectric array, molecular beacons, cDNA sequencing, clone hybridization, cDNA fragment fingerprinting, serial analysis of gene expression (SAGE), subtractive hybridization, differential display and/or differential screening (see, e.g., Lockhart and Winzeler (2000) *Nature* 405:827-836, and references cited therein).

For example, specific PCR primers are designed to a member(s) of a candidate nucleotide library. cDNA is prepared from subject sample RNA by reverse transcription from a poly-dT oligonucleotide primer, and subjected to PCR. Double stranded cDNA may be prepared using primers suitable for reverse transcription of the PCR product, followed by amplification of the cDNA using in vitro transcription. The product of in vitro transcription is a sense-RNA corresponding to the original member(s) of the candidate library. PCR product may be also be evaluated in a number of ways known in the art, including real-time assessment using detection of labeled primers, e.g. TaqMan or molecular beacon probes.

Technology platforms suitable for analysis of PCR products include the ABI 7700, 5700, or 7000 Sequence Detection Systems (Applied Biosystems, Foster City, Calif.), the MJ Research Opticon (MJ Research, Waltham, Mass.), the Roche Light Cycler (Roche Diagnositics, Indianapolis, Ind.), the Stratagene MX4000 (Stratagene, La Jolla, Calif.), and the Bio-Rad iCycler (Bio-Rad Laboratories, Hercules, Calif.). Alternatively, molecular beacons are used to detect presence of a nucleic acid sequence in an unamplified RNA or cDNA sample, or following amplification of the sequence using any method, e.g. IVT (In Vitro transcription) or NASBA (nucleic acid sequence based amplification). Molecular beacons are designed with sequences complementary to member(s) of a candidate nucleotide library, and are linked to fluorescent labels. Each probe has a different fluorescent label with non-overlapping emission wavelengths. For example, expression of ten genes may be assessed using ten different sequence-specific molecular beacons.

Alternatively, or in addition, molecular beacons are used to assess expression of multiple nucleotide sequences at once. Molecular beacons with sequence complimentary to the members of a diagnostic nucleotide set are designed and linked to fluorescent labels. Each fluorescent label used must have a non-overlapping emission wavelength. For example, 10 nucleotide sequences can be assessed by hybridizing 10 sequence specific molecular beacons (each labeled with a different fluorescent molecule) to an amplified or un-amplified RNA or cDNA sample. Such an assay bypasses the need for sample labeling procedures.

Alternatively, or in addition bead arrays can be used to assess expression of multiple sequences at once (See, e.g, LabMAP 100, Luminex Corp, Austin, Tex.). Alternatively, or in addition electric arrays are used to assess expression of multiple sequences, as exemplified by the e-Sensor technology of Motorola (Chicago, Ill.) or Nanochip technology of Nanogen (San Diego, Calif.)

Of course, the particular method elected will be dependent on such factors as quantity of RNA recovered, practitioner preference, available reagents and equipment, detectors, and the like. Typically, however, the elected method(s) will be appropriate for processing the number of samples and probes of interest. Methods for high-throughput expression analysis are discussed below.

Alternatively, expression at the level of protein products of gene expression is performed. For example, protein expression, in a sample of leukocytes, can be evaluated by one or more method selected from among: western analysis, two-dimensional gel analysis, chromatographic separation, mass spectrometric detection, protein-fusion reporter constructs, colorimetric assays, binding to a protein array and characterization of polysomal mRNA. One particularly favorable approach involves binding of labeled protein expression products to an array of antibodies specific for members of the candidate library. Methods for producing and evaluating antibodies are widespread in the art, see, e.g., Coligan, supra; and Harlow and Lane (1989) *Antibodies: A Laboratory Manual*, Cold Spring Harbor Press, NY ("Harlow and Lane"). Additional details regarding a variety of immunological and immunoassay procedures adaptable to the present invention by selection of antibody reagents specific for the products of candidate nucleotide sequences can be found in, e.g., Stites and Terr (eds.)(1991) *Basic and Clinical Immunology*, 7$^{th}$ ed., and Paul, supra. Another approach uses systems for performing desorption spectrometry. Commercially available systems, e.g., from Ciphergen Biosystems, Inc. (Fremont, Calif.) are particularly well suited to quantitative analysis of protein expression. Indeed, Protein Chip® arrays (see, e.g., the website, ciphergen.com) used in desorption spectrometry approaches provide arrays for detection of protein expression. Alternatively, affinity reagents, (e.g., antibodies, small molecules, etc.) are developed that recognize epitopes of the protein product. Affinity assays are used in protein array assays, e.g. to detect the presence or absence of particular proteins. Alternatively, affinity reagents are used to detect expression using the methods described above. In the case of a protein that is expressed on the cell surface of leukocytes, labeled affinity reagents are bound to populations of leukocytes, and leukocytes expressing the protein are identified and counted using fluorescent activated cell sorting (FACS).

It is appreciated that the methods of expression evaluation discussed herein, although discussed in the context of discovery of diagnostic nucleotide sets, are also applicable for expression evaluation when using diagnostic nucleotide sets for, e.g. diagnosis of diseases, as further discussed below.

High Throughput Expression Assays

A number of suitable high throughput formats exist for evaluating gene expression. Typically, the term high throughput refers to a format that performs at least about 100 assays, or at least about 500 assays, or at least about 1000 assays, or at least about 5000 assays, or at least about 10,000 assays, or more per day. When enumerating assays, either the number of samples or the number of candidate nucleotide sequences evaluated can be considered. For example, a northern analysis of, e.g., about 100 samples performed in a gridded array, e.g., a dot blot, using a single probe corresponding to a candidate nucleotide sequence can be considered a high throughput assay. More typically, however, such an assay is performed as a series of duplicate blots, each evaluated with a distinct probe corresponding to a different member of the candidate library. Alternatively, methods that simultaneously evaluate expression of about 100 or more candidate nucleotide sequences in one or more samples, or in multiple samples, are considered high throughput.

Numerous technological platforms for performing high throughput expression analysis are known. Generally, such methods involve a logical or physical array of either the subject samples, or the candidate library, or both. Common array formats include both liquid and solid phase arrays. For example, assays employing liquid phase arrays, e.g., for hybridization of nucleic acids, binding of antibodies or other receptors to ligand, etc., can be performed in multiwell, or microtiter, plates. Microtiter plates with 96, 384 or 1536 wells are widely available, and even higher numbers of wells, e.g., 3456 and 9600 can be used. In general, the choice of microtiter plates is determined by the methods and equipment, e.g., robotic handling and loading systems, used for sample preparation and analysis. Exemplary systems include, e.g., the ORCA™ system from Beckman-Coulter, Inc. (Fullerton, Calif.) and the Zymate systems from Zymark Corporation (Hopkinton, Mass.).

Alternatively, a variety of solid phase arrays can favorably be employed in to determine expression patterns in the context of the invention. Exemplary formats include membrane or filter arrays (e.g, nitrocellulose, nylon), pin arrays, and bead arrays (e.g., in a liquid "slurry"). Typically, probes corresponding to nucleic acid or protein reagents that specifically interact with (e.g., hybridize to or bind to) an expression product corresponding to a member of the candidate library are immobilized, for example by direct or indirect cross-linking, to the solid support. Essentially any solid support capable of withstanding the reagents and conditions necessary for performing the particular expression assay can be utilized. For example, functionalized glass, silicon, silicon dioxide, modified silicon, any of a variety of polymers, such as (poly)tetrafluoroethylene, (poly)vinylidenedifluoride, polystyrene, polycarbonate, or combinations thereof can all serve as the substrate for a solid phase array.

In a preferred embodiment, the array is a "chip" composed, e.g., of one of the above-specified materials. Polynucleotide probes, e.g., RNA or DNA, such as cDNA, synthetic oligonucleotides, and the like, or binding proteins such as antibodies, that specifically interact with expression products of individual components of the candidate library are affixed to the chip in a logically ordered manner, i.e., in an array. In addition, any molecule with a specific affinity for either the sense or anti-sense sequence of the marker nucleotide sequence (depending on the design of the sample labeling), can be fixed to the array surface without loss of specific affinity for the marker and can be obtained and produced for array production, for example, proteins that specifically recognize the specific nucleic acid sequence of the marker, ribozymes, peptide nucleic acids (PNA), or other chemicals or molecules with specific affinity.

Detailed discussion of methods for linking nucleic acids and proteins to a chip substrate, are found in, e.g., U.S. Pat. No. 5,143,854 "Large Scale Photolithographic Solid Phase Synthesis Of Polypeptides And Receptor Binding Screening Thereof" to Pirrung et al., issued, Sep. 1, 1992; U.S. Pat. No. 5,837,832 "Arrays Of Nucleic Acid Probes On Biological Chips" to Chee et al., issued Nov. 17, 1998; U.S. Pat. No. 6,087,112 "Arrays With Modified Oligonucleotide And Polynucleotide Compositions" to Dale, issued Jul. 11, 2000; U.S. Pat. No. 5,215,882 "Method Of Immobilizing Nucleic Acid On A Solid Substrate For Use In Nucleic Acid Hybridization Assays" to Bahl et al., issued Jun. 1, 1993; U.S. Pat. No. 5,707,807 "Molecular Indexing For Expressed Gene Analysis" to Kato, issued Jan. 13, 1998; U.S. Pat. No. 5,807,522 "Methods For Fabricating Microarrays Of Biological Samples" to Brown et al., issued Sep. 15, 1998; U.S. Pat. No. 5,958,342 "Jet Droplet Device" to Gamble et al., issued Sep. 28, 1999; U.S. Pat. No. 5,994,076 "Methods Of Assaying Differential Expression" to Chenchik et al., issued Nov. 30, 1999; U.S. Pat. No. 6,004,755 "Quantitative Microarray Hybridization Assays" to Wang, issued Dec. 21, 1999; U.S. Pat. No. 6,048,695 "Chemically Modified Nucleic Acids And Method For Coupling Nucleic Acids To Solid Support" to Bradley et al., issued Apr. 11, 2000; U.S. Pat. No. 6,060,240 "Methods For Measuring Relative Amounts Of Nucleic Acids In A Complex Mixture And Retrieval Of Specific Sequences Therefrom" to Kamb et al., issued May 9, 2000; U.S. Pat. No. 6,090,556 "Method For Quantitatively Determining The Expression Of A Gene" to Kato, issued Jul. 18, 2000; and U.S. Pat. No. 6,040,138 "Expression Monitoring By Hybridization To High Density Oligonucleotide Arrays" to Lockhart et al., issued Mar. 21, 2000 each of which are hereby incorporated by reference in their entirety.

For example, cDNA inserts corresponding to candidate nucleotide sequences, in a standard TA cloning vector are amplified by a polymerase chain reaction for approximately 30-40 cycles. The amplified PCR products are then arrayed onto a glass support by any of a variety of well-known techniques, e.g., the VSLIPS™ technology described in U.S. Pat. No. 5,143,854. RNA, or cDNA corresponding to RNA, isolated from a subject sample of leukocytes is labeled, e.g., with a fluorescent tag, and a solution containing the RNA (or cDNA) is incubated under conditions favorable for hybridization, with the "probe" chip. Following incubation, and washing to eliminate non-specific hybridization, the labeled nucleic acid bound to the chip is detected qualitatively or quantitatively, and the resulting expression profile for the corresponding candidate nucleotide sequences is recorded. It is appreciated that the probe used for diagnostic purposes may be identical to the probe used during diagnostic nucleotide sequence discovery and validation. Alternatively, the probe sequence may be different than the sequence used in diagnostic nucleotide sequence discovery and validation. Multiple cDNAs from a nucleotide sequence that are non-overlapping or partially overlapping may also be used.

In another approach, oligonucleotides corresponding to members of a candidate nucleotide library are synthesized and spotted onto an array. Alternatively, oligonucleotides are synthesized onto the array using methods known in the art, e.g. Hughes, et al. supra. The oligonucleotide is designed to be complementary to any portion of the candidate nucleotide sequence. In addition, in the context of expression analysis for, e.g. diagnostic use of diagnostic nucleotide sets, an oligonucleotide can be designed to exhibit particular hybridization characteristics, or to exhibit a particular specificity and/or sensitivity, as further described below.

Oligonucleotide probes are also prepared using the DNA sequence information for the candidate genes identified by differential hybridization screening (listed in Tables 3, 8-10 and the Sequence Listing) and/or the sequence information for the genes identified by database mining (listed in Table 2) is used to design complimentary oligonucleotide probes. Oligo probes are designed on a contract basis by various companies (for example, Compugen, Mergen, Affymetrix, Telechem), or designed from the candidate sequences using a variety of parameters and algorithms as indicated at the website genome.wi.mit.edu/cgi-bin/primer/primer3.cgi. Briefly, the length of the oligonucleotide to be synthesized is determined, preferably at least 16 nucleotides, generally 18-24 nucleotides, 24-70 nucleotides and, in some circumstances, more than 70 nucleotides. The sequence analysis algorithms and tools described above are applied to the sequences to mask repetitive elements, vector sequences and low complexity sequences. Oligonucleotides are selected that are specific to the candidate nucleotide sequence (based on a Blast n search of the oligonucleotide sequence in question against gene sequences databases, such as the Human Genome Sequence, UniGene, dbEST or the non-redundant database at NCBI), and have <50% G content and 25-70% G+C content. Desired oligonucleotides are synthesized using well-known methods and apparatus, or ordered from a company (for example Sigma). Oligonucleotides are spotted onto microarrays. Alternatively, oligonucleotides are synthesized directly on the array surface, using a variety of techniques (Hughes et al. 2001, Yershov et al. 1996, Lockhart et al 1996).

Hybridization signal may be amplified using methods known in the art, and as described herein, for example use of the Clontech kit (Glass Fluorescent Labeling Kit), Stratagene kit (Fairplay Microarray Labeling Kit), the Micromax kit (New England Nuclear, Inc.), the Genisphere kit (3DNA Sub-micro), linear amplification, e.g. as described in U.S. Pat. No. 6,132,997 or described in Hughes, T R, et al., Nature Biotechnology, 19:343-347 (2001) and/or Westin et al. *Nat Biotech.* 18:199-204. In some cases, amplification techniques do not increase signal intensity, but allow assays to be done with small amounts of RNA.

Alternatively, fluorescently labeled cDNA are hybridized directly to the microarray using methods known in the art. For example, labeled cDNA are generated by reverse transcription using Cy3- and Cy5-conjugated deoxynucleotides, and the reaction products purified using standard methods. It is appreciated that the methods for signal amplification of expression data useful for identifying diagnostic nucleotide sets are also useful for amplification of expression data for diagnostic purposes.

Microarray expression may be detected by scanning the microarray with a variety of laser or CCD-based scanners, and extracting features with numerous software packages, for example, Imagene (Biodiscovery), Feature Extraction Software (Agilent), Scanalyze (Eisen, M. 1999. SCANALYZE User Manual; Stanford Univ., Stanford, Calif. Ver 2.32.), GenePix (Axon Instruments).

In another approach, hybridization to microelectric arrays is performed, e.g. as described in Umek et al (2001) *J Mol Diagn.* 3:74-84. An affinity probe, e.g. DNA, is deposited on a metal surface. The metal surface underlying each probe is connected to a metal wire and electrical signal detection system. Unlabelled RNA or cDNA is hybridized to the array, or alternatively, RNA or cDNA sample is amplified before hybridization, e.g. by PCR. Specific hybridization of sample RNA or cDNA results in generation of an electrical signal, which is transmitted to a detector. See Westin (2000) *Nat Biotech.* 18:199-204 (describing anchored multiplex amplification of a microelectronic chip array); Edman (1997) *NAR* 25:4907-14; Vignali (2000) *J Immunol Methods* 243:243-55.

In another approach, a microfluidics chip is used for RNA sample preparation and analysis. This approach increases efficiency because sample preparation and analysis are streamlined. Briefly, microfluidics may be used to sort specific leukocyte sub-populations prior to RNA preparation and analysis. Microfluidics chips are also useful for, e.g., RNA preparation, and reactions involving RNA (reverse transcription, RT-PCR). Briefly, a small volume of whole, anti-coagulated blood is loaded onto a microfluidics chip, for example chips available from Caliper (Mountain View, Calif.) or Nanogen (San Diego, Calif.) A microfluidics chip may contain channels and reservoirs in which cells are moved and reactions are performed. Mechanical, electrical, magnetic, gravitational, centrifugal or other forces are used to move the cells and to expose them to reagents. For example, cells of whole blood are moved into a chamber containing hypotonic saline, which results in selective lysis of red blood cells after a 20-minute incubation. Next, the remaining cells (leukocytes) are moved into a wash chamber and finally, moved into a chamber containing a lysis buffer such as guanidine isothyocyanate. The leukocyte cell lysate is further processed for RNA isolation in the chip, or is then removed for further processing, for example, RNA extraction by standard methods. Alternatively, the microfluidics chip is a circular disk containing ficoll or another density reagent. The blood sample is injected into the center of the disc, the disc is rotated at a speed that generates a centrifugal force appropriate for density gradient separation of mononuclear cells, and the separated mononuclear cells are then harvested for further analysis or processing.

It is understood that the methods of expression evaluation, above, although discussed in the context of discovery of diagnostic nucleotide sets, are also applicable for expression evaluation when using diagnostic nucleotide sets for, e.g. diagnosis of diseases, as further discussed below.

Evaluation of Expression Patterns

Expression patterns can be evaluated by qualitative and/or quantitative measures. Certain of the above described techniques for evaluating gene expression (as RNA or protein products) yield data that are predominantly qualitative in nature. That is, the methods detect differences in expression that classify expression into distinct modes without providing significant information regarding quantitative aspects of expression. For example, a technique can be described as a qualitative technique if it detects the presence or absence of expression of a candidate nucleotide sequence, i.e., an on/off pattern of expression. Alternatively, a qualitative technique measures the presence (and/or absence) of different alleles, or variants, of a gene product.

In contrast, some methods provide data that characterize expression in a quantitative manner. That is, the methods relate expression on a numerical scale, e.g., a scale of 0-5, a scale of 1-10, a scale of +–+++, from grade 1 to grade 5, a grade from a to z, or the like. It will be understood that the numerical, and symbolic examples provided are arbitrary, and that any graduated scale (or any symbolic representation of a graduated scale) can be employed in the context of the present invention to describe quantitative differences in nucleotide sequence expression. Typically, such methods yield information corresponding to a relative increase or decrease in expression.

Any method that yields either quantitative or qualitative expression data is suitable for evaluating expression of candidate nucleotide sequence in a subject sample of leukocytes. In some cases, e.g., when multiple methods are employed to determine expression patterns for a plurality of candidate nucleotide sequences, the recovered data, e.g., the expression profile, for the nucleotide sequences is a combination of quantitative and qualitative data.

In some applications, expression of the plurality of candidate nucleotide sequences is evaluated sequentially. This is typically the case for methods that can be characterized as low- to moderate-throughput. In contrast, as the throughput of the elected assay increases, expression for the plurality of candidate nucleotide sequences in a sample or multiple samples of leukocytes, is assayed simultaneously. Again, the methods (and throughput) are largely determined by the individual practitioner, although, typically, it is preferable to employ methods that permit rapid, e.g. automated or partially automated, preparation and detection, on a scale that is time-efficient and cost-effective.

It is understood that the preceding discussion, while directed at the assessment of expression of the members of candidate libraries, is also applies to the assessment of the expression of members of diagnostic nucleotide sets, as further discussed below.

Genotyping

In addition to, or in conjunction with the correlation of expression profiles and clinical data, it is often desirable to correlate expression patterns with the subject's genotype at one or more genetic loci or to correlate both expression profiles and genetic loci data with clinical data. The selected loci can be, for example, chromosomal loci corresponding to one or more member of the candidate library, polymorphic alleles for marker loci, or alternative disease related loci (not contributing to the candidate library) known to be, or putatively associated with, a disease (or disease criterion). Indeed, it will be appreciated, that where a (polymorphic) allele at a locus is linked to a disease (or to a predisposition to a disease), the presence of the allele can itself be a disease criterion.

Numerous well known methods exist for evaluating the genotype of an individual, including southern analysis, restriction fragment length polymorphism (RFLP) analysis, polymerase chain reaction (PCR), amplification length polymorphism (AFLP) analysis, single stranded conformation polymorphism (SSCP) analysis, single nucleotide polymorphism (SNP) analysis (e.g., via PCR, Taqman or molecular beacons), among many other useful methods. Many such procedures are readily adaptable to high throughput and/or automated (or semi-automated) sample preparation and analysis methods. Most, can be performed on nucleic acid samples recovered via simple procedures from the same sample of leukocytes as yielded the material for expression profiling. Exemplary techniques are described in, e.g., Sambrook, and Ausubel, supra.

Identification of the Diagnostic Oligonucleotides and Oligonucleotide Sets of the Invention Identification of diagnostic nucleotides and nucleotide sets and disease specific target nucleotide sequence proceeds by correlating the leukocyte expression profiles with data regarding the subject's health status to produce a data set designated a "molecular signature." Examples of data regarding a patient's health status, also termed "disease criteria(ion) ", is described below and in the Section titled "selected diseases," below. Methods useful for correlation analysis are further described elsewhere in the specification.

Generally, relevant data regarding the subject's health status includes retrospective or prospective health data, e.g., in the form of the subject's medical history, as provided by the subject, physician or third party, such as, medical diagnoses, laboratory test results, diagnostic test results, clinical events, or medication lists, as further described below. Such data may include information regarding a patient's response to treatment and/or a particular medication and data regarding the presence of previously characterized "risk factors." For example, cigarette smoking and obesity are previously identified risk factors for heart disease. Further examples of health status information, including diseases and disease criteria, is described in the section titled Selected diseases, below.

Typically, the data describes prior events and evaluations (i.e., retrospective data). However, it is envisioned that data collected subsequent to the sampling (i.e., prospective data) can also be correlated with the expression profile. The tissue sampled, e.g., peripheral blood, bronchial lavage, etc., can be obtained at one or more multiple time points and subject data is considered retrospective or prospective with respect to the time of sample procurement.

Data collected at multiple time points, called "longitudinal data", is often useful, and thus, the invention encompasses the analysis of patient data collected from the same patient at different time points. Analysis of paired samples, such as samples from a patient at different times, allows identification of differences that are specifically related to the disease state since the genetic variability specific to the patient is controlled for by the comparison. Additionally, other variables that exist between patients may be controlled for in this way, for example, the presence or absence of inflammatory diseases (e.g., rheumatoid arthritis) the use of medications that may effect leukocyte gene expression, the presence or absence of co-morbid conditions, etc. Methods for analysis of paired samples are further described below. Moreover, the analysis of a pattern of expression profiles (generated by collecting multiple expression profiles) provides information relating to changes in expression level over time, and may permit the determination of a rate of change, a trajectory, or an expression curve. Two longitudinal samples may provide information on the change in expression of a gene over time, while three longitudinal samples may be necessary to determine the "trajectory" of expression of a gene. Such information may be relevant to the diagnosis of a disease. For example, the expression of a gene may vary from individual to individual, but a clinical event, for example, a heart attack, may cause the level of expression to double in each patient. In this example, clinically interesting information is gleaned from the change in expression level, as opposed to the absolute level of expression in each individual.

When a single patient sample is obtained, it may still be desirable to compare the expression profile of that sample to some reference expression profile. In this case, one can determine the change of expression between the patient's sample and a reference expression profile that is appropriate for that patient and the medical condition in question. For example, a reference expression profile can be determined for all patients without the disease criterion in question who have similar characteristics, such as age, sex, race, diagnoses etc.

Generally, small sample sizes of 10-40 samples from 10-20 individuals are used to identify a diagnostic nucleotide set. Larger sample sizes are generally necessary to validate the diagnostic nucleotide set for use in large and varied patient populations, as further described below. For example, extension of gene expression correlations to varied ethnic groups, demographic groups, nations, peoples or races may require expression correlation experiments on the population of interest.

Expression Reference Standards

Expression profiles derived from a patient (i.e., subjects diagnosed with, or exhibiting symptoms of, or exhibiting a disease criterion, or under a doctor's care for a disease) sample are compared to a control or standard expression RNA to facilitate comparison of expression profiles (e.g. of a set of candidate nucleotide sequences) from a group of patients relative to each other (i.e., from one patient in the group to other patients in the group, or to patients in another group).

The reference RNA used should have desirable features of low cost and simplicity of production on a large scale. Additionally, the reference RNA should contain measurable amounts of as many of the genes of the candidate library as possible.

For example, in one approach to identifying diagnostic nucleotide sets, expression profiles derived from patient samples are compared to a expression reference "standard." Standard expression reference can be, for example, RNA derived from resting cultured leukocytes or commercially available reference RNA, such as Universal reference RNA from Stratagene. See Nature, V406, 8-17-00, p. 747-752. Use of an expression reference standard is particularly useful when the expression of large numbers of nucleotide sequences is assayed, e.g. in an array, and in certain other applications, e.g. qualitative PCR, RT-PCR, etc., where it is desirable to compare a sample profile to a standard profile, and/or when large numbers of expression profiles, e.g. a patient population, are to be compared. Generally, an expression reference standard should be available in large quantities, should be a good substrate for amplification and labeling reactions, and should be capable of detecting a large percentage of candidate nucleic acids using suitable expression profiling technology.

Alternatively, or in addition, the expression profile derived from a patient sample is compared with the expression of an internal reference control gene, for example, β-actin or CD4. The relative expression of the profiled genes and the internal reference control gene (from the same individual) is obtained. An internal reference control may also be used with a reference RNA. For example, an expression profile for "gene 1" and the gene encoding CD4 can be determined in a patient sample and in a reference RNA. The expression of each gene can be expressed as the "relative" ratio of expression the gene in the patient sample compared with expression of the gene in the reference RNA. The expression ratio (sample/reference) for gene 1 may be divided by the expression ration for CD4 (sample/reference) and thus the relative expression of gene 1 to CD4 is obtained.

The invention also provides a buffy coat control RNA useful for expression profiling, and a method of using control RNA produced from a population of buffy coat cells, the white blood cell layer derived from the centrifugation of whole blood. Buffy coat contains all white blood cells, including granulocytes, mononuclear cells and platelets. The invention also provides a method of preparing control RNA from buffy coat cells for use in expression profile analysis of leukocytes. Buffy coat fractions are obtained, e.g. from a blood bank or directly from individuals, preferably from a large number of individuals such that bias from individual samples is avoided and so that the RNA sample represents an average expression of a healthy population. Buffy coat fractions from about 50 or about 100, or more individuals are preferred. 10 ml buffy coat from each individual is used. Buffy coat samples are treated with an erthythrocyte lysis buffer, so that erthythrocytes are selectively removed. The leukocytes of the buffy coat layer are collected by centrifugation. Alternatively, the buffy cell sample can be further enriched for a particular leukocyte sub-populations, e.g. mononuclear cells, T-lymphocytes, etc. To enrich for mononuclear cells, the buffy cell pellet, above, is diluted in PBS (phosphate buffered saline) and loaded onto a non-polystyrene tube containing a polysucrose and sodium diatrizoate solution adjusted to a density of 1.077+/−0.001 g/ml. To enrich for T-lymphocytes, 45 ml of whole blood is treated with RosetteSep (Stem Cell Technologies), and incubated at room temperature for 20 minutes. The mixture is diluted with an equal volume of PBS plus 2% FBS and mixed by inversion. 30 ml of diluted mixture is layered on top of 15 ml DML medium (Stem Cell Technologies). The tube is centrifuged at 1200×g, and the enriched cell layer at the plasma: medium interface is removed, washed with PBS+2% FBS, and cells collected by centrifugation at 1200×g. The cell pellet is treated with 5 ml of erythrocyte lysis buffer (EL buffer, Qiagen) for 10 minutes on ice, and enriched T-lymphoctes are collected by centrifugation.

In addition or alternatively, the buffy cells (whole buffy coat or sub-population, e.g. mononuclear fraction) can be cultured in vitro and subjected to stimulation with cytokines or activating chemicals such as phorbol esters or ionomycin. Such stimuli may increase expression of nucleotide sequences that are expressed in activated immune cells and might be of interest for leukocyte expression profiling experiments.

Following sub-population selection and/or further treatment, e.g. stimulation as described above, RNA is prepared using standard methods. For example, cells are pelleted and lysed with a phenol/guanidinium thiocyanate and RNA is prepared. RNA can also be isolated using a silica gel-based purification column or the column method can be used on RNA isolated by the phenol/guanidinium thiocyanate method. RNA from individual buffy coat samples can be pooled during this process, so that the resulting reference RNA represents the RNA of many individuals and individual bias is minimized or eliminated. In addition, a new batch of buffy coat reference RNA can be directly compared to the last batch to ensure similar expression pattern from one batch to another, using methods of collecting and comparing expression profiles described above/below. One or more expression reference controls are used in an experiment. For example, RNA derived from one or more of the following sources can be used as controls for an experiment: stimulated or unstimulated whole buffy coat, stimulated or unstimulated peripheral mononuclear cells, or stimulated or unstimulated T-lymphocytes.

Alternatively, the expression reference standard can be derived from any subject or class of subjects including healthy subjects or subjects diagnosed with the same or a different disease or disease criterion. Expression profiles from subjects in two or more distinct classes are compared to determine which subset of nucleotide sequences in the candidate library can best distinguish between the subject classes, as further discussed below. It will be appreciated that in the present context, the term "distinct classes" is relevant to at least one distinguishable criterion relevant to a disease of interest, a "disease criterion." The classes can, of course, demonstrate significant overlap (or identity) with respect to other disease criteria, or with respect to disease diagnoses, prognoses, or the like. The mode of discovery involves, e.g., comparing the molecular signature of different subject classes to each other (such as patient to control, patients with a first diagnosis to patients with a second diagnosis, etc.) or by comparing the molecular signatures of a single individual taken at different time points. The invention can be applied to a broad range of diseases, disease criteria, conditions and other clinical and/or epidemiological questions, as further discussed above/below.

It is appreciated that while the present discussion pertains to the use of expression reference controls while identifying diagnostic nucleotide sets, expression reference controls are also useful during use of diagnostic nucleotide sets, e.g. use of a diagnostic nucleotide set for diagnosis of a disease, as further described below.

Analysis of Expression Profiles

In order to facilitate ready access, e.g., for comparison, review, recovery, and/or modification, the molecular signatures/expression profiles are typically recorded in a database. Most typically, the database is a relational database accessible by a computational device, although other formats, e.g., manually accessible indexed files of expression profiles as photographs, analogue or digital imaging readouts, spreadsheets, etc. can be used. Further details regarding preferred embodiments are provided below. Regardless of whether the expression patterns initially recorded are analog or digital in nature and/or whether they represent quantitative or qualitative differences in expression, the expression patterns, expression profiles (collective expression patterns), and molecular signatures (correlated expression patterns) are stored digitally and accessed via a database. Typically, the database is compiled and maintained at a central facility, with access being available locally and/or remotely.

As additional samples are obtained, and their expression profiles determined and correlated with relevant subject data, the ensuing molecular signatures are likewise recorded in the database. However, rather than each subsequent addition being added in an essentially passive manner in which the data from one sample has little relation to data from a second (prior or subsequent) sample, the algorithms optionally additionally query additional samples against the existing database to further refine the association between a molecular signature and disease criterion. Furthermore, the data set comprising the one (or more) molecular signatures is optionally queried against an expanding set of additional or other disease criteria. The use of the database in integrated systems and web embodiments is further described below.

Analysis of Expression Profile Data from Arrays

Expression data is analyzed using methods well known in the art, including the software packages Imagene (Biodiscovery, Marina del Rey, Calif.), Feature Extraction Software (Agilent, Palo Alto, Calif.), and Scanalyze (Stanford University). In the discussion that follows, a "feature" refers to an individual spot of DNA on an array. Each gene may be represented by more than one feature. For example, hybridized microarrays are scanned and analyzed on an Axon Instruments scanner using GenePix 3.0 software (Axon Instruments, Union City, Calif.). The data extracted by GenePix is used for all downstream quality control and expression evaluation. The data is derived as follows. The data for all features flagged as "not found" by the software is removed from the dataset for individual hybridizations. The "not found" flag by GenePix indicates that the software was unable to discriminate the feature from the background. Each feature is examined to determine the value of its signal. The median pixel intensity of the background ($B_n$) is subtracted from the median pixel intensity of the feature ($F_n$) to produce the background-subtracted signal (hereinafter, "BGSS"). The BGSS is divided by the standard deviation of the background pixels to provide the signal-to-noise ratio (hereinafter, "S/N"). Features with a S/N of three or greater in both the Cy3 channel (corresponding to the sample RNA) and Cy5 channel (corresponding to the reference RNA) are used for further analysis (hereinafter denoted "useable features"). Alternatively, different S/Ns are used for selecting expression data for an analysis. For example, only expression data with signal to noise ratios >3 might be used in an analysis. Alternatively, features with S/N values <3 may be flagged as such and included in the analysis. Such flagged data sets include more values and may allow one to discover expression markers that would be missed otherwise. However, such data sets may have a higher variablilty than filtered data, which may decrease significance of findings or performance of correlation statistics.

For each usable feature (i), the expression level (e) is expressed as the logarithm of the ratio (R) of the Background Subtracted Signal (hereinafter "BGSS") for the Cy3 (sample RNA) channel divided by the BGSS for the Cy5 channel (reference RNA). This "log ratio" value is used for comparison to other experiments.

$$R_i = \frac{BGSS_{sample}}{BGSS_{reference}} \quad (0.1)$$

$$e_i = \log r_i \quad (0.2)$$

Variation in signal across hybridizations may be caused by a number of factors affecting hybridization, DNA spotting, wash conditions, and labeling efficiency.

A single reference RNA may be used with all of the experimental RNAs, permitting multiple comparisons in addition to individual comparisons. By comparing sample RNAs to the same reference, the gene expression levels from each sample are compared across arrays, permitting the use of a consistent denominator for our experimental ratios.

Scaling

The data may be scaled (normalized) to control for labeling and hybridization variability within the experiment, using methods known in the art. Scaling is desirable because it facilitates the comparison of data between different experiments, patients, etc. Generally the BGSS are scaled to a factor such as the median, the mean, the trimmed mean, and percentile. Additional methods of scaling include: to scale between 0 and 1, to subtract the mean, or to subtract the median.

Scaling is also performed by comparison to expression patterns obtained using a common reference RNA, as described in greater detail above. As with other scaling methods, the reference RNA facilitates multiple comparisons of the expression data, e.g., between patients, between samples, etc. Use of a reference RNA provides a consistent denominator for experimental ratios.

In addition to the use of a reference RNA, individual expression levels may be adjusted to correct for differences in labeling efficiency between different hybridization experiments, allowing direct comparison between experiments with different overall signal intensities, for example. A scaling factor (a) may be used to adjust individual expression levels as follows. The median of the scaling factor (a), for example, BGSS, is determined for the set of all features with a S/N greater than three. Next, the $BGSS_i$ (the BGSS for each feature "i") is divided by the median for all features (a), generating a scaled ratio. The scaled ration is used to determine the expression value for the feature ($e_i$), or the log ratio.

$$S_i = \frac{BGSS_i}{a} \quad (0.3)$$

$$e_i = \log\left(\frac{Cy3S_i}{Cy5S_i}\right) \quad (0.4)$$

In addition, or alternatively, control features are used to normalize the data for labeling and hybridization variability within the experiment. Control feature may be cDNA for genes from the plant, *Arabidopsis thaliana*, that are included when spotting the mini-array. Equal amounts of RNA complementary to control cDNAs are added to each of the samples before they were labeled. Using the signal from these control genes, a normalization constant (L) is determined according to the following formula:

$$L_j = \frac{\sum_{i=1}^{N} BGSS_{j,i}}{\sum_{j=1}^{K} \frac{\sum_{i=1}^{N} BGSS_{j,i}}{N}}$$

where $BGSS_j$ is the signal for a specific feature, N is the number of *A. thaliana* control features, K is the number of hybridizations, and $L_j$ is the normalization constant for each individual hybridization.

Using the formula above, the mean for all control features of a particular hybridization and dye (e.g., Cy3) is calculated. The control feature means for all Cy3 hybridizations are averaged, and the control feature mean in one hybridization divided by the average of all hybridizations to generate a normalization constant for that particular Cy3 hybridization ($L_j$), which is used as a in equation (0.3). The same normalization steps may be performed for Cy3 and Cy5 values.

Many additional methods for normalization exist and can be applied to the data. In one method, the average ratio of Cy3 BGSS/Cy5 BGSS is determined for all features on an array. This ratio is then scaled to some arbitrary number, such as 1 or some other number. The ratio for each probe is then multiplied by the scaling factor required to bring the average ratio to the chosen level. This is performed for each array in an analysis. Alternatively, the ratios are normalized to the average ratio across all arrays in an analysis.

If multiple features are used per gene sequence or oligonucleotide, these repeats can be used to derive an average expression value for each gene. If some of the replicate features are of poor qualitay and don't meet requirements for analysis, the remaining features can be used to represent the gene or gene sequence.

Correlation Analysis

Correlation analysis is performed to determine which array probes have expression behavior that best distinguishes or serves as markers for relevant groups of samples representing a particular clinical condition. Correlation analysis, or comparison among samples representing different disease criteria (e.g., clinical conditions), is performed using standard statistical methods. Numerous algorithms are useful for correlation analysis of expression data, and the selection of algorithms depends in part on the data analysis to be performed. For example, algorithms can be used to identify the single most informative gene with expression behavior that reliably classifies samples, or to identify all the genes useful to classify samples. Alternatively, algorithms can be applied that determine which set of 2 or more genes have collective expression behavior that accurately classifies samples. The use of multiple expression markers for diagnostics may overcome the variability in expression of a gene between individuals, or overcome the variability intrinsic to the assay. Multiple expression markers may include redundant markers (surrogates), in that two or more genes or probes may provide the same information with respect to diagnosis. This may occur, for example, when two or more genes or gene probes are coordinately expressed. For diagnostic application, it may be appropriate to utilize a gene and one or more of its surrogates in the assay. This redundancy may overcome failures (technical or biological) of a single marker to distinguish samples. Alternatively, one or more surrogates may have properties that make them more suitable for assay development, such as a higher baseline level of expression, better cell specificity, a higher fold change between sample groups or more specific sequence for the design of PCR primers or complimentary probes. It will be appreciated that while the discussion above pertains to the analysis of RNA expression profiles the discussion is equally applicable to the analysis of profiles of proteins or other molecular markers.

Prior to analysis, expression profile data may be formatted or prepared for analysis using methods known in the art. For example, often the log ratio of scaled expression data for every array probe is calculated using the following formula:

log (Cy 3 BGSS/Cy5 BGSS), where Cy 3 signal corresponds to the expression of the gene in the clinical sample, and Cy5 signal corresponds to expression of the gene in the reference RNA.

Data may be further filtered depending on the specific analysis to be done as noted below. For example, filtering may be aimed at selecting only samples with expression above a certain level, or probes with variability above a certain level between sample sets.

The following non-limiting discussion consider several statistical methods known in the art. Briefly, the t-test and ANOVA are used to identify single genes with expression differences between or among populations, respectively. Multivariate methods are used to identify a set of two or more genes for which expression discriminates between two disease states more specifically than expression of any single gene.

t-Test

The simplest measure of a difference between two groups is the Student's t test. See, e.g., Welsh et al. (2001) Proc *Natl Acad Sci USA* 98:1176-81 (demonstrating the use of an unpaired Student's t-test for the discovery of differential gene expression in ovarian cancer samples and control tissue samples). The t-test assumes equal variance and normally distributed data. This test identifies the probability that there is a difference in expression of a single gene between two groups of samples. The number of samples within each group that is required to achieve statistical significance is dependent upon the variation among the samples within each group. The standard formula for a t-test is:

$$t(e_i) = \frac{\bar{e}_{i,c} - \bar{e}_{i,t}}{\sqrt{(s_{i,c}^2/n_c) + (s_{i,t}^2/n_t)}},$$ (0.5)

where $\bar{e}_i$ is the difference between the mean expression level of gene i in groups c and t, $s_{i,c}$ is the variance of gene x in group c and $s_{i,t}$ is the variance of gene x in group t. $n_c$ and $n_i$ are the numbers of samples in groups c and t.

The combination of the t statistic and the degrees of freedom [$\min(n_t, n_c)-1$] provides a p value, the probability of rejecting the null hypothesis. A p-value of $\leq 0.01$, signifying a 99 percent probability the mean expression levels are different between the two groups (a 1% chance that the mean expression levels are in fact not different and that the observed difference occurred by statistical chance), is often considered acceptable.

When performing tests on a large scale, for example, on a large dataset of about 8000 genes, a correction factor must be included to adjust for the number of individual tests being performed. The most common and simplest correction is the Bonferroni correction for multiple tests, which divides the p-value by the number of tests run. Using this test on an 8000 member dataset indicates that a p value of >0.00000125 is required to identify genes that are likely to be truly different between the two test conditions.

Significance Analysis for Microarrays (SAM)

Significance analysis for microarrays (SAM) (Tusher 2001) is a method through which genes with a correlation between their expression values and the response vector are statistically discovered and assigned a statistical significance. The ratio of false significant to significant genes is the False Discovery Rate (FDR). This means that for each threshold there are a set of genes which are called significant, and the FDR gives a confidence level for this claim. If a gene is called differentially expressed between 2 classes by SAM, with a FDR of 5%, there is a 95% chance that the gene is actually differentially expressed between the classes. SAM takes into account the variability and large number of variables of microarrays. SAM will identiy genes that are most globally differentially expressed between the classes. Thus, important genes for identifying and classifying outlier samples or patients may not be identified by SAM.

Wilcoxon's Signed Ranks Test

This method is non-parametric and is utilized for paired comparisons. See e.g., Sokal and Rohlf (1987) *Introduction to Biostatistics* 2$^{nd}$ edition, WH Freeman, New York. At least 6 pairs are necessary to apply this statistic. This test is useful for analysis of paired expression data (for example, a set of patients who have had samples taken before and after administration of a pharmacologic agent).

ANOVA

Differences in gene expression across multiple related groups may be assessed using an Analysis of Variance (ANOVA), a method well known in the art (Michelson and Schofield, 1996).

Multivariate Analysis

Many algorithms suitable for multivariate analysis are known in the art (Katz 1999). Generally, a set of two or more genes for which expression discriminates between two disease states more specifically than expression of any single gene is identified by searching through the possible combinations of genes using a criterion for discrimination, for example the expression of gene X must increase from normal 300 percent, while the expression of genes Y and Z must decrease from normal by 75 percent. Ordinarily, the search starts with a single gene, then adds the next best fit at each step of the search. Alternatively, the search starts with all of the genes and genes that do not aid in the discrimination are eliminated step-wise.

Paired Samples

Paired samples, or samples collected at different time-points from the same patient, are often useful, as described above. For example, use of paired samples permits the reduction of variation due to genetic variation among individuals. In addition, the use of paired samples has a statistical significance in that data derived from paired samples can be calculated in a different manner that recognizes the reduced variability. For example, the formula for a t-test for paired samples is:

$$t(e_x) = \frac{\overline{D}_{e_x}}{\sqrt{\frac{\sum D^2 - (\sum D)^2 / b}{b-1}}} \qquad (0.5)$$

where D is the difference between each set of paired samples and b is the number of sample pairs. $\overline{D}$ is the mean of the differences between the members of the pairs. In this test, only the differences between the paired samples are considered, then grouped together (as opposed to taking all possible differences between groups, as would be the case with an ordinary t-test). Additional statistical tests useful with paired data, e.g., ANOVA and Wilcoxon's signed rank test, are discussed above.

Diagnostic Classification

Once a discriminating set of genes is identified, the diagnostic classifier (a mathematical function that assigns samples to diagnostic categories based on expression data) is applied to unknown sample expression levels.

Methods that can be used for this analysis include the following non-limiting list:

CLEAVER is an algorithm used for classification of useful expression profile data. See Raychaudhuri et al. (2001) *Trends Biotechnol* 19:189-193. CLEAVER uses positive training samples (e.g., expression profiles from samples known to be derived from a particular patient or sample diagnostic category, disease or disease criteria), negative training samples (e.g., expression profiles from samples known not to be derived from a particular patient or sample diagnostic category, disease or disease criteria) and test samples (e.g., expression profiles obtained from a patient), and determines whether the test sample correlates with the particular disease or disease criteria, or does not correlate with a particular disease or disease criteria. CLEAVER also generates a list of the 20 most predictive genes for classification.

Artificial neural networks (hereinafter, "ANN") can be used to recognize patterns in complex data sets and can discover expression criteria that classify samples into more than 2 groups. The use of artificial neural networks for discovery of gene expression diagnostics for cancers using expression data generated by oligonucleotide expression microarrays is demonstrated by Khan et al. (2001) *Nature Med.* 7:673-9. Khan found that 96 genes provided 0% error rate in classification of the tumors. The most important of these genes for classification was then determined by measuring the sensitivity of the classification to a change in expression of each gene. Hierarchical clustering using the 96 genes results in correct grouping of the cancers into diagnostic categories.

Golub uses cDNA microarrays and a distinction calculation to identify genes with expression behavior that distinguishes myeloid and lymphoid leukemias. See Golub et al. (1999) *Science* 286:531-7. Self organizing maps were used for new class discovery. Cross validation was done with a "leave one out" analysis. 50 genes were identified as useful markers. This was reduced to as few as 10 genes with equivalent diagnostic accuracy.

Hierarchical and non-hierarchical clustering methods are also useful for identifying groups of genes that correlate with a subset of clinical samples such as those with and without Lupus. Alizadeh used hierarchical clustering as the primary tool to distinguish different types of diffuse B-cell lymphomas based on gene expression profile data. See Alizadeh et al. (2000) *Nature* 403:503-11. Alizadeh used hierarchical clustering, as the primary tool to distinguish different types of diffuse B-cell lymphomas based on gene expression profile data. A cDNA array carrying 17856 probes was used for these experiments, 96 samples were assessed on 128 arrays, and a set of 380 genes was identified as being useful for sample classification.

Perou demonstrates the use of hierarchical clustering for the molecular classification of breast tumor samples based on expression profile data. See Perou el al. (2000) *Nature* 406: 747-52. In this work, a cDNA array carrying 8102 gene probes was used. 1753 of these genes were found to have high variation between breast tumors and were used for the analysis.

Hastie describes the use of gene shaving for discovery of expression markers. Hastie et al. (2000) *Genome Biol.* 1(2): RESEARCH 0003.1-0003.21. The gene shaving algorithm identifies sets of genes with similar or coherent expression patterns, but large variation across conditions (RNA samples, sample classes, patient classes). In this manner, genes with a tight expression pattern within a diagnostic group, but also with high variability across the diagnoses are grouped together. The algorithm takes advantage of both characteristics in one grouping step. For example, gene shaving can identify useful marker genes with co-regulated expression. Sets of useful marker genes can be reduced to a smaller set, with each gene providing some non-redundant value in classification. This algorithm was used on the data set described in Alizadeh et al., supra, and the set of 380 informative gene markers was reduced to 234.

Supervised harvesting of expression trees (Hastie 2001) identifies genes or clusters that best distinguish one class from all the others on the data set. The method is used to identify the genes/clusters that can best separate one class versus all the others for datasets that include two or more classes or all classes from each other. This algorithm can be used for discovery or testing of a diagnostic gene set.

CART is a decision tree classification algorithm (Breiman 1984). From gene expression and or other data, CART can develop a decision tree for the classification of samples. Each node on the decision tree involves a query about the expression level of one or more genes or variables. Samples that are above the threshold go down one branch of the decision tree and samples that are not go down the other branch. See examples 10 and 16 for further description of its use in classification analysis and examples of its usefulness in discovering and implementing a diagnostic gene set. CART identifies surrogates for each splitter (genes that are the next best substitute for a useful gene inclassification.

Once a set of genes and expression criteria for those genes have been established for classification, cross validation is done. There are many approaches, including a 10 fold cross validation analysis in which 10% of the training samples are left out of the analysis and the classification algorithm is built with the remaining 90%. The 10% are then used as a test set for the algorithm. The process is repeated 10 times with 10% of the samples being left out as a test set each time. Through this analysis, one can derive a cross validation error which helps estimate the robustness of the algorithm for use on prospective (test) samples.

Clinical data are gathered for every patient sample used for expression analysis. Clinical variables can be quantitative or non-quantitative. A clinical variable that is quantitiative can be used as a variable for significance or classification analysis. Non-quantitative clinical variables, such as the sex of the patient, can also be used in a significance analysis or classification analysis with some statistical tool. It is appreciated that the most useful diagnostic gene set for a condition may be optimal when considered along with one or more predictive clinical variables. Clinical data can also be used as supervising vectors for a correlation analysis. That is to say that the clinical data associated with each sample can be used to divide the samples into meaningful diagnostic categories for analysis. For example, samples can be divided into 2 or more groups based on the presence or absence of some diagnostic criterion (a). In addition, clinical data can be utilized to select patients for a correlation analysis or to exclude them based on some undesirable characteristic, such as an ongoing infection, a medicine or some other issue. Clincial data can also be used to assess the pre-test probability of an outcome. For example, patients who are female are much more likely to be diagnosed as having systemic lupus erythematosis than patients who are male.

Once a set of genes are identified that classify samples with acceptable accuracy. These genes are validated as a set using new samples that were not used to discover the gene set. These samples can be taken from frozen archieves from the discovery clinical study or can be taken from new patients prospectively. Validation using a "test set" of samples can be done using expression profiling of the gene set with microarrays or using real-time PCR for each gene on the test set samples. Alternatively, a different expression profiling technology can be used.

Validation and Accuracy of Diagnostic Nucleotide Sets

Prior to widespread application of the diagnostic probe sets of the invention the predictive value of the probe set is validated. When the diagnostic probe set is discovered by microarray based expression analysis, the differential expression of the member genes may be validated by a less variable and more quantitive and accurate technology such as real time PCR. In this type of experiment the amplification product is measured during the PCR reaction. This enables the researcher to observe the amplification before any reagent becomes rate limiting for amplification. In kinetic PCR the measurement is of $C_T$ (threshold cycle) or $C_P$ (crossing point). This measurement ($C_T=C_P$) is the point at which an amplification curve crosses a threshold fluorescence value. The threshold is set to a point within the area where all of the reactions were in their linear phase of amplification. When measuring $C_T$, a lower $C_T$ value is indicative of a higher amount of starting material since an earlier cycle number means the threshold was crossed more quickly.

Several fluorescence methodologies are available to measure amplification product in real-time PCR. Taqman (Applied BioSystems, Foster City, Calif.) uses fluorescence resonance energy transfer (FRET) to inhibit signal from a probe until the probe is degraded by the sequence specific binding and Taq 3' exonuclease activity. Molecular Beacons (Stratagene, La Jolla, Calif.) also use FRET technology, whereby the fluorescence is measured when a hairpin structure is relaxed by the specific probe binding to the amplified DNA. The third commonly used chemistry is Sybr Green, a DNA-binding dye (Molecular Probes, Eugene, Oreg.). The more amplified product that is produced, the higher the signal. The Sybr Green method is sensitive to non-specific amplification products, increasing the importance of primer design and selection. Other detection chemistries can also been used, such as ethedium bromide or other DNA-binding dyes and many modifications of the fluorescent dye/quencher dye Taqman chemistry, for example scorpions.

Real-time PCR validation can be done as described in Example 15.

Typically, the oligonucleotide sequence of each probe is confirmed, e.g. by DNA sequencing using an oligonucleotide-specific primer. Partial sequence obtained is generally sufficient to confirm the identity of the oligonucleotide probe. Alternatively, a complementary polynucleotide is fluorescently labeled and hybridized to the array, or to a different array containing a resynthesized version of the oligo nucleotide probe, and detection of the correct probe is confirmed.

Typically, validation is performed by statistically evaluating the accuracy of the correspondence between the molecular signature for a diagnostic probe set and a selected indicator. For example, the expression differential for a nucleotide sequence between two subject classes can be expressed as a simple ratio of relative expression. The expression of the nucleotide sequence in subjects with selected indicator can be compared to the expression of that nucleotide sequence in subjects without the indicator, as described in the following equations.

$\Sigma E_x ai/N = E_x A$ the average expression of nucleotide sequence x in the members of group A;

$\Sigma E_x bi/M = E_x B$ the average expression of nucleotide sequence x in the members of group B;

$\Sigma E_x A/E_x B = \Delta E_x AB$ the average differential expression of nucleotide sequence x between groups A and B:

where $\Sigma$ indicates a sum; Ex is the expression of nucleotide sequence x relative to a standard; ai are the individual members of group A, group A has N members; bi are the individual members of group B, group B has M members.

Individual components of a diagnostic probe set each have a defined sensitivity and specificity for distinguishing between subject groups. Such individual nucleotide sequences can be employed in concert as a diagnostic probe set to increase the sensitivity and specificity of the evaluation. The database of molecular signatures is queried by algorithms to identify the set of nucleotide sequences (i.e., corresponding to members of the probe set) with the highest average differential expression between subject groups. Typically, as the number of nucleotide sequences in the diagnostic probe set increases, so does the predictive value, that is, the sensitivity and specificity of the probe set. When the probe sets are defined they may be used for diagnosis and patient monitoring as discussed below. The diagnostic sensitivity and specificity of the probe sets for the defined use can be determined for a given probe set with specified expression levels as demonstrated above. By altering the expression threshold required for the use of each nucleotide sequence as a diagnostic, the sensitivity and specificity of the probe set can be altered by the practitioner. For example, by lowering the magnitude of the expression differential threshold for each nucleotide sequence in the set, the sensitivity of the test will increase, but the specificity will decrease. As is apparent from the foregoing discussion, sensitivity and specificity are inversely related and the predictive accuracy of the probe set is continuous and dependent on the expression threshold set for each nucleotide sequence. Although sensitivity and specificity tend to have an inverse relationship when expression thresholds are altered, both parameters can be increased as nucleotide sequences with predictive value are added to the diagnostic nucleotide set. In addition a single or a few markers may not be reliable expression markers across a population of patients. This is because of the variability in expression and measurement of expression that exists between measurements, individuals and individuals over time. Inclusion of a large number of candidate nucleotide sequences or large numbers of nucleotide sequences in a diagnostic nucleotide set allows for this variability as not all nucleotide sequences need to meet a threshold for diagnosis. Generally, more markers are better than a single marker. If many markers are used to make a diagnosis, the likelihood that all expression markers will not meet some thresholds based upon random variability is low and thus the test will give fewer false negatives. Surrogate markers are useful for these purposes. These are markers or genes that are coordinately expressed. Surrogate markers essential provide redundant infomation, but this redundancy can improve accuracy by decreasing errors due to assay variability.

It is appreciated that the desired diagnostic sensitivity and specificity of the diagnostic nucleotide set may vary depending on the intended use of the set. For example, in certain uses, high specificity and high sensitivity are desired. For example, a diagnostic nucleotide set for predicting which patient population may experience side effects may require high sensitivity so as to avoid treating such patients. In other settings, high sensitivity is desired, while reduced specificity may be tolerated. For example, in the case of a beneficial treatment with few side effects, it may be important to identify as many patients as possible (high sensitivity) who will respond to the drug, and treatment of some patients who will not respond is tolerated. In other settings, high specificity is desired and reduced sensitivity may be tolerated. For example, when identifying patients for an early-phase clinical trial, it is important to identify patients who may respond to the particular treatment. Lower sensitivity is tolerated in this setting as it merely results in reduced patients who enroll in the study or requires that more patients are screened for enrollment.

To discover and validate a gene set that can be applied to accurately diagnose or classify patients across the country or around the world, it is necessary to ensure that the gene set was developed and validated using samples that represent the types of patients that will be encountered in the clinical setting. For example, diverse ethnicity, drug usage and clinical practice patterns must all be represented in the discovery and validation to ensure that the test works on this variety of patients.

Selected Diseases

In principle, individual oligonucleotides and diagnostic oligonucleotide sets of the invention may be developed and applied to essentially any disease, or disease criterion, as long as at least one subset of oligonucleotide sequences is differentially expressed in samples derived from one or more individuals with a disease criteria or disease and one or more individuals without the disease criteria or disease, wherein the individual may be the same individual sampled at different points in time, or the individuals may be different individuals (or populations of individuals). For example, the subset of oligonucleotide sequences may be differentially expressed in the sampled tissues of subjects with the disease or disease criterion (e.g., a patient with a disease or disease criteria) as compared to subjects without the disease or disease criterion (e.g., patients without a disease (control patients)). Alternatively, or in addition, the subset of oligonucleotide sequence(s) may be differentially expressed in different samples taken from the same patient, e.g at different points in time, at different disease stages, before and after a treatment, in the presence or absence of a risk factor, etc.

Expression profiles corresponding to oligonucleotides and sets of oligonucleotide sequences that correlate not with a diagnosis, but rather with a particular aspect of a disease can also be used to identify the diagnostic oligonucleotide sets and disease specific target oligonucleotide sequences of the invention. For example, such an aspect, or disease criterion, can relate to a subject's medical or family history, e.g., occurance of an autoimmune disease, childhood illness, cause of death of a parent or other relative, prior surgery or other intervention, medications, laboratory values and results of diagnostic testing (radiology, pathology, etc.), symptoms (including onset and/or duration of symptoms), etc. Alternatively, the disease criterion can relate to a diagnosis, e.g., chronic inflammatory disease such as lupus, rheumatoid arthritis, osteoarthritis, or prognosis (e.g., prediction of future diagnoses, events or complications), e.g., renal failure from lupus, joint replacement surgery for rheumatoid arthritis, rheumatoid arthritis or systemic lupus erythematosis disease activity or the like. In other cases, the disease criterion corresponds to a therapeutic outcome, e.g., response to a medication, response to a surgery or physical therapy for a joint. Alternatively, the disease criteria correspond with previously identified or classic risk factors and may correspond to prognosis or future disease diagnosis. As indicated above, a disease criterion can also correspond to genotype for one or more loci. Disease criteria (including patient data) may be collected (and compared) from the same patient at different points in time, from different patients, between patients with a disease (criterion) and patients respresenting a control population, etc. Longitudinal data, i.e., data collected at different time points from an individual (or group of individuals) may be used for comparisons of samples obtained from an individual (group of individuals) at different points in time, to permit identification of differences specifically related to the disease state, and to obtain information relating to the change in expression over time, including a rate of change or trajectory of expression over time. The usefulness of longitudinal data is further discussed in the section titled "Identification of diagnostic nucleotide sets of the invention".

It is further understood that diagnostic oligonucleotides and oligonucleotide sets may be developed for use in diagnosing conditions for which there is no present means of diagnosis. For example, in rheumatoid arthritis, joint destruction is often well under way before a patient experience symptoms of the condition. A diagnostic nucleotide or nucleotide set may be developed that diagnoses rheumatic joint destruction at an earlier stage than would be possible using present means of diagnosis, which rely in part on the presentation of symptoms by a patient. Diagnostic nucleotide sets may also be developed to replace or augment current diagnostic procedures. For example, the use of a diagnostic nucleotide or nucleotide set to diagnose lupus may replace or supplement the current diagnostic tests and strategies.

It is understood that the following discussion of diseases is exemplary and non-limiting, and further that the general criteria discussed above, e.g. use of family medical history, are generally applicable to the specific diseases discussed below.

In addition to leukocytes, as described throughout, the general method is applicable to oligonucleotide sequences that are differentially expressed in any subject tissue or cell type, by the collection and assessment of samples of that tissue or cell type. However, in many cases, collection of such samples presents significant technical or medical problems given the current state of the art.

Systemic Lupus Erythematosis (SLE)

SLE is a chronic, systemic inflammatory disease characterized by dysregulation of the immune system, which effects up to 2 million patients in the US. Symptoms of SLE include rashes, joint pain, abnormal blood counts, renal dysfunction and damage, infections, CNS disorders, arthralgias and autoimmunity. Patients may also have early onset atherosclerosis. The diagnosis of SLE is difficult to make with certainty using current diagnostic tests and algorithms. Antibody tests can be specific for the disease, but often lack sensitivity. Clinical diagnosis may lack both high sensisivity and specificity. SLE is a disease that clearly involves differential gene expression in leukocytes compared to patients without the disease.

Diagnostic oligonucleotides and oligonucleotide sets are identified and validated for use in diagnosis and monitoring of SLE activity and progression. Disease criteria correspond to clinical data, e.g. symptom rash, joint pain, malaise, rashes, blood counts (white and red), tests of renal function e.g. creatinine, blood urea nitrogen (hereinafter, "bun") creative clearance, data obtained from laboratory tests, including complete blood counts with differentials, CRP, ESR, ANA, Serum IL6, Soluble CD40 ligand, LDL, HDL, Anti-DNA antibodies, rheumatoid factor, C3, C4, serum creatinine and any medication levels, the need for pain medications, cumulative doses or immunosuppressive therapy, symptoms or any manifestation of carotid atherosclerosis (e.g. ultrasound diagnosis or any other manifestations of the disease), data from surgical procedures such as gross operative findings and pathological evaluation of resected tissues and biopsies (e.g., renal, CNS), information on pharmacological therapy and treatment changes, clinical diagnoses of disease "flare", hospitalizations, death, response to medications, quantitative joint exams, results from health assessment questionnaires (HAQs), and other clinical measures of patient symptoms and disability. In addition, disease criteria correspond to the clinical score known as SLEDAI (Bombadier C, Gladman D D, Urowitz M B, Caron D, Chang C H and the Committee on Prognosis Studies in SLE: Derivation of the SLEDAI for Lupus Patients. *Arthritis Rheum* 35:630-640, 1992.). Diagnostic nucleotide sets may be useful for diagnosis of SLE, monitoring disease progression including progressive renal dysfunction, carotid atherosclerosis and CNS dysfunction, and predicting occurrence of side-effects, for example.

Rheumatoid Arthritis

Rheumatoid arthritis (RA) effects about two million patients in the US and is a chronic and debilitating inflammatory arthritis, particularly involving pain and destruction of the joints. RA often goes undiagnosed because patients may have no pain, but the disease is actively destroying the joint. Other patients are known to have RA, and are treated to alleviate symptoms, but the rate of progression of joint destruction can't easily be monitored. Drug therapy is available, but the most effective medicines are toxic (e.g., steroids, methotrexate) and thus need to be used with caution. A new class of medications (TNF blockers) is very effective, but the drugs are expensive, have side effects, and not all patients respond. Side-effects are common and include immune suppression, toxicity to organ systems, allergy and metabolic disturbances.

Diagnostic oligonucleotides and oligonucleotide sets of the invention are developed and validated for use in diagnosis and treatment of RA. Disease criteria correspond to disease symptoms (e.g., joint pain, joint swelling and joint stiffness and any of the American College for Rheumatology criteria for the diagnosis of RA, see Arnett et al (1988) *Arthr. Rheum.* 31:315-24), progression of joint destruction (e.g. as measured by serial hand radiographs, assessment of joint function and mobility), surgery, need for medication, additional diagnoses of inflammatory and non-inflammatory conditions, and clinical laboratory measurements including complete blood counts with differentials, CRP, ESR, ANA, Serum IL6, Soluble CD40 ligand, LDL, HDL, Anti-DNA antibodies, rheumatoid factor, C3, C4, serum creatinine, death, hospitalization and disability due to joint destruction. In addition, or alternatively, disease criteria correspond to response to drug therapy and presence or absence of side-effects or measures of improvement exemplified by the American College of Rheumatology "20%" and "50%" response/improvement rates. See Felson et al (1995) *Arthr Rheum* 38:531-37. Diagnostic nucleotide sets are identified that monitor and predict disease progression including flaring (acute worsening of disease accompanied by joint pain or other symptoms), response to drug treatment and likelihood of side-effects.

In addition to peripheral leukocytes, surgical specimens of rheumatoid joints can be used for leukocyte expression profiling experiments. Members of diagnostic nucleotide sets are candidates for leukocyte target nucleotide sequences, e.g. as a candidate drug target for rheumatoid arthritis. Synovial specimens can be used for expression profiling or cells derived and sorted from that tissue (such as subsets of leukocytes) can be used. Cells can be separated by fluorescence activated cell sorting or magnetic affinity reagent techniques or some other technique. Synovial specimens and blood can be obtained from the same patient and gene expression can be compared between these 2 sample types.

Osteoarthritis 20-40 million patients in the US have osteoarthritis. Patient groups are heterogeneous, with a subset of patients having earlier onset, more aggressive joint damage, involving more inflammation (leukocyte infiltration). Leukocyte diagnostics can be used to distinguish osteoarthritis from rheumatoid arthritis and other differential diagnoses, define likelihood and degree of response to NSAID therapy (non-steroidal anti-inflammatory drugs) or other anti-inflammatory therapies. Rate of progression of joint damage can also be assessed. Diagnostic nucleotide sets may be developed for use in selection and titration of treatment therapies. Disease criteria correspond to response to therapy, and disease progression using certain therapies, response to medications, need for joint surgery, joint pain and disability.

In addition to peripheral leukocytes, surgical specimens of osteoarthritic joints can be used for leukocyte expression profiling experiments. Diagnostic oligonucleotides and diagnostic oligonucleotide sets are candidates for leukocyte target nucleotide sequences, e.g. as a candidate drug target for osteoarthritis. Synovial specimens can be used for expression profiling or cells derived and sorted from that tissue (such as subsets of leukocytes) can be used. Cells can be separated by fluorescence activated cell sorting or magnetic affinity reagent techniques or some other technique. Synovial specimens and blood can be obtained from the same patient and gene expression can be compared between these 2 sample types.

In another example, diagnostic nucleotide sets are developed and validated for use in diagnosis and therapy of peri-prosthetic osteolysis. In this disease, a prosthetic joint such as a knee or hip is found to loosen over time and requires repeat surgery. Loosening may occur in some patients due to an inflammatory response incited by the foreign material of the prosthesis. Disease criteria include joint loosening, radiographic evidence of peri-prosthetic osteolysis, need for repeat surgery, response to pharmacological therapy, and/or histological (from biopsy or surgery) or biochemical (markers of bone metabolism such as alkaline phosphatase) evidence of osteolysis. Tissues used for expression profiling can include peripheral leukocytes or leukocyte subsets, periprosthetic tissue, or synovial fluid. In addition, gene sets can be discovered using an in vitromodel of the disease in which immune cells are exposed to prosthesis materials such as cement or titanium.

Pharmacogenomics

Pharmacogenomics is the study of the individual propensity to respond to a particular drug therapy (combination of therapies). In this context, response can mean whether a particular drug will work on a particular patient, e.g. some patients respond to one drug but not to another drug. Response can also refer to the likelihood of successful treatment or the assessment of progress in treatment. Titration of drug therapy to a particular patient is also included in this description, e.g. different patients can respond to different doses of a given medication. This aspect may be important when drugs with side-effects or interactions with other drug therapies are contemplated.

Diagnostic oligonucleotides and oligonucleotide sets are developed and validated for use in assessing whether a patient will respond to a particular therapy and/or monitoring response of a patient to drug therapy(therapies). Disease criteria correspond to presence or absence of clinical symptoms or clinical endpoints, presence of side-effects or interaction with other drug(s). The diagnostic nucleotide set may further comprise nucleotide sequences that are targets of drug treatment or markers of active disease.

Diagnostic oligonucleotides and oligonucleotide sets are developed and validated for use in assessing whether a patient has a particular drug toxicity or toxicity due to an environmental, work-related or other agent. Such exposures of the patient may also be related to biological or biochemical agents used in warfare. Diagnostic oligonucleotides and oligonucleotide sets may allow early diagnosis of a toxicity or exposure or may monitor the severity and course of toxic responses.

Methods of Using Diagnostic Oligonucleotides and Oligonucleotide Sets.

The invention also provide methods of using the diagnostic oligonucleotides and oligonucleotide sets to: diagnose or monitor disease; assess severity of disease; predict future occurrence of disease; predict future complications of disease; determine disease prognosis; evaluate the patient's risk, or "stratify" a group of patients; assess response to current drug therapy; assess response to current non-pharmacological therapy; determine the most appropriate medication or treatment for the patient; predict whether a patient is likely to respond to a particular drug; and determine most appropriate additional diagnostic testing for the patient, among other clinically and epidemiologically relevant applications.

The oligonucleotides and oligonucleotide sets of the invention can be utilized for a variety of purposes by physicians, healthcare workers, hospitals, laboratories, patients, companies and other institutions. As indicated previously, essentially any disease, condition, or status for which at least one nucleotide sequence is differentially expressed in leukocyte populations (or sub-populations) can be evaluated, e.g., diagnosed, monitored, etc. using the diagnostic nucleotide sets and methods of the invention. In addition to assessing health status at an individual level, the diagnostic nucleotide sets of the present invention are suitable for evaluating subjects at a "population level," e.g., for epidemiological studies, or for population screening for a condition or disease.

Collection and Preparation of Sample

RNA, protein and/or DNA are prepared using methods well-known in the art, as further described herein. It is appreciated that subject samples collected for use in the methods of the invention are generally collected in a clinical setting, where delays may be introduced before RNA samples are prepared from the subject samples of whole blood, e.g. the blood sample may not be promptly delivered to the clinical lab for further processing. Further delay may be introduced in the clinical lab setting where multiple samples are generally being processed at any given time. For this reason, methods that feature lengthy incubations of intact leukocytes at room temperature are not preferred, because the expression profile of the leukocytes may change during this extended time period. For example, RNA can be isolated from whole blood using a phenol/guanidine isothiocyanate reagent or another direct whole-blood lysis method, as described in, e.g., U.S. Pat. Nos. 5,346,994 and 4,843,155. This method may be less preferred under certain circumstances because the large majority of the RNA recovered from whole blood RNA extraction comes from erythrocytes since these cells outnumber leukocytes 1000:1. Care must be taken to ensure that the presence of erythrocyte RNA and protein does not introduce bias in the RNA expression profile data or lead to inadequate sensitivity or specificity of probes.

Alternatively, intact leukocytes may be collected from whole blood using a lysis buffer that selectively lyses erythrocytes, but not leukocytes, as described, e.g., in (U.S. Pat. Nos. 5,973,137, and 6,020,186). Intact leukocytes are then collected by centrifugation, and leukocyte RNA is isolated using standard protocols, as described herein. However, this method does not allow isolation of sub-populations of leukocytes, e.g. mononuclear cells, which may be desired. In addition, the expression profile may change during the lengthy incubation in lysis buffer, especially in a busy clinical lab where large numbers of samples are being prepared at any given time.

Alternatively, specific leukocyte cell types can be separated using density gradient reagents (Boyum, A, 1968.). For example, mononuclear cells may be separated from whole blood using density gradient centrifugation, as described, e.g., in U.S. Pat. Nos. 4,190,535, 4,350,593, 4,751,001, 4,818,418, and 5,053,134. Blood is drawn directly into a tube containing an anticoagulant and a density reagent (such as Ficoll or Percoll). Centrifugation of this tube results in separation of blood into an erythrocyte and granulocyte layer, a mononuclear cell suspension, and a plasma layer. The mononuclear cell layer is easily removed and the cells can be collected by centrifugation, lysed, and frozen. Frozen samples are stable until RNA can be isolated. Density centrifugation, however, must be conducted at room temperature, and if processing is unduly lengthy, such as in a busy clinical lab, the expression profile may change.

The quality and quantity of each clinical RNA sample is desirably checked before amplification and labeling for array hybridization, using methods known in the art. For example, one microliter of each sample may be analyzed on a Bioanalyzer (Agilent 2100 Palo Alto, Calif. USA) using an RNA 6000 nano LabChip (Caliper, Mountain View, Calif. USA).

Degraded RNA is identified by the reduction of the 28S to 18S ribosomal RNA ratio and/or the presence of large quantities of RNA in the 25-100 nucleotide range.

It is appreciated that the RNA sample for use with a diagnostic oligonucleotide or oligonucleotide set may be produced from the same or a different cell population, sub-population and/or cell type as used to identify the diagnostic nucleotide set. For example, a diagnostic oligonucleotide or oligonucleotide set identified using RNA extracted from mononuclear cells may be suitable for analysis of RNA extracted from whole blood or mononuclear cells, depending on the particular characteristics of the members of the diagnostic nucleotide set. Generally, diagnostic oligonucleotides or oligonucleotide sets must be tested and validated when used with RNA derived from a different cell population, sub-population or cell type than that used when obtaining the diagnostic gene set. Factors such as the cell-specific gene expression of diagnostic nucleotide set members, redundancy of the information provided by members of the diagnostic nucleotide set, expression level of the member of the diagnostic nucleotide set, and cell-specific alteration of expression of a member of the diagnostic nucleotide set will contribute to the usefullness of a different RNA source than that used when identifying the members of the diagnostic nucleotide set. It is appreciated that it may be desirable to assay RNA derived from whole blood, obviating the need to isolate particular cell types from the blood.

Assessing Expression for Diagnostics

Expression profiles for the oligonucleotides or the set of diagnostic oligonucleotide sequences in a subject sample can be evaluated by any technique that determines the expression of each component oligonucleotide sequence. Methods suitable for expression analysis are known in the art, and numerous examples are discussed in the Sections titled "Methods of obtaining expression data" and "high throughput expression Assays", above.

In many cases, evaluation of expression profiles is most efficiently, and cost effectively, performed by analyzing RNA expression. Alternatively, the proteins encoded by each component of the diagnostic nucleotide set are detected for diagnostic purposes by any technique capable of determining protein expression, e.g., as described above. Expression profiles can be assessed in subject leukocyte sample using the same or different techniques as those used to identify and validate the diagnostic oligonucleotide or oligonucleotide set. For example, a diagnostic nucleotide set identified as a subset of sequences on a cDNA microarray can be utilized for diagnostic (or prognostic, or monitoring, etc.) purposes on the same array from which they were identified. Alternatively, the diagnostic nucleotide sets for a given disease or condition can be organized onto a dedicated sub-array for the indicated purpose. It is important to note that if diagnostic nucleotide sets are discovered using one technology, e.g. RNA expression profiling, but applied as a diagnostic using another technology, e.g. protein expression profiling, the nucleotide (or gene, or protein) sets must generally be validated for diagnostic purposes with the new technology. In addition, it is appreciated that diagnostic nucleotide sets that are developed for one use, e.g. to diagnose a particular disease, may later be found to be useful for a different application, e.g. to predict the likelihood that the particular disease will occur. Generally, the diagnostic nucleotide set will need to be validated for use in the second circumstance. As discussed herein, the sequence of diagnostic nucleotide set members may be amplified from RNA or cDNA using methods known in the art providing specific amplification of the nucleotide sequences.

Identification of Novel Nucleotide Sequences that are Differentially Expressed in Leukocytes Novel nucleotide sequences that are differentially expressed in leukocytes are also part of the invention. Previously unidentified open reading frames may be identified in a library of differentially expressed candidate nucleotide sequences, as described above, and the DNA and predicted protein sequence may be identified and characterized as noted above. We identified unnamed (not previously described as corresponding to a gene, or an expressed gene) nucleotide sequences in our candidate nucleotide library, depicted in Table 3A, 3B AND 3C and the sequence listing. Accordingly, further embodiments of the invention are the isolated nucleic acids described in Tables 3A and 3B AND 3C and in the sequence listing. The novel differentially expressed nucleotide sequences of the invention are useful in the diagnostic nucleotide set of the invention described above, and are further useful as members of a diagnostic nucleotide set immobilized on an array. The novel partial nucleotide sequences may be further characterized using sequence tools and publically or privately accessible sequence databases, as is well known in the art: Novel differentially expressed nucleotide sequences may be identified as disease target nucleotide sequences, described below. Novel nucleotide sequences may also be used as imaging reagent, as further described below.

As used herein, "novel nucleotide sequence" refers to (a) a nucleotide sequence containing at least one of the DNA sequences disclosed herein (as shown in FIGS. Table 3A, 3B and the sequence listing); (b) any DNA sequence that encodes the amino acid sequence encoded by the DNA sequences disclosed herein; (c) any DNA sequence that hybridizes to the complement of the coding sequences disclosed herein, contained within the coding region of the nucleotide sequence to which the DNA sequences disclosed herein (as shown in Table 3A, 3B AND 3C and the sequence listing) belong, under highly stringent conditions, e.g., hybridization to filter-bound DNA in 0.5 M $NaHPO_4$, 7% sodium dodecyl sulfate (SDS), 1 mM EDTA at 65° C., and washing in 0.1×SSC/0.1% SDS at 68° C. (Ausubel F. M. et al., eds., 1989, Current Protocols in Molecular Biology, Vol. 1, Green Publishing Associates, Inc., and John Wiley & sons, Inc., New York, at p. 2.10.3), (d) any DNA sequence that hybridizes to the complement of the coding sequences disclosed herein, (as shown in Table 3A, 3B AND 3C and the sequence listing) contained within the coding region of the nucleotide sequence to which DNA sequences disclosed herein (as shown in TABLES 3A, 3B and the sequence listing) belong, under less stringent conditions, such as moderately stringent conditions, e.g., washing in 0.2×SSC/0.1% SDS at 42° C. (Ausubel et al., 1989, supra), yet which still encodes a functionally equivalent gene product; and/or (e) any DNA sequence that is at least 90% identical, at least 80% identical or at least 70% identical to the coding sequences disclosed herein (as shown in TABLES 3A, 3B AND 3C and the sequence listing), wherein % identity is determined using standard algorithms known in the art.

The invention also includes nucleic acid molecules, preferably DNA molecules, that hybridize to, and are therefore the complements of, the DNA sequences (a) through (c), in the preceding paragraph. Such hybridization conditions may be highly stringent or less highly stringent, as described above. In instances wherein the nucleic acid molecules are deoxyoligonucleotides ("oligos"), highly stringent conditions may refer, e.g., to washing in 6×SSC/0.05% sodium pyrophosphate at 37° C. (for 14-base oligos), 48° C. (for 17-base oligos), 55° C. (for 20-base oligos), and 60° C. (for 23-base oligos). These nucleic acid molecules may act as target nucleotide sequence antisense molecules, useful, for example, in target nucleotide sequence regulation and/or as antisense primers in amplification reactions of target nucleotide sequence nucleic acid sequences. Further, such sequences may be used as part of ribozyme and/or triple helix sequences, also useful for target nucleotide sequence regulation. Still further, such molecules may be used as components of diagnostic methods whereby the presence of a disease-causing allele, may be detected.

The Invention Also Encompasses Nucleic Acid Molecules Contained in Full-Length Gene Sequences That Are Related to Or Derived From Sequences In Tables 2, 3, 8-10 and the Sequence Listing. One Sequence May Map to More Than One Full-Length Gene.

The invention also encompasses (a) DNA vectors that contain any of the foregoing coding sequences and/or their complements (i.e., antisense); (b) DNA expression vectors that contain any of the foregoing coding sequences operatively associated with a regulatory element that directs the expression of the coding sequences; and (c) genetically engineered host cells that contain any of the foregoing coding sequences operatively associated with a regulatory element that directs the expression of the coding sequences in the host cell. As used herein, regulatory elements include but are not limited to inducible and non-inducible promoters, enhancers, operators and other elements known to those skilled in the art that drive and regulate expression. The invention includes fragments of any of the DNA sequences disclosed herein. Fragments of the DNA sequences may be at least 5, at least 10, at least 15, at least 19 nucleotides, at least 25 nucleotides, at least 50 nucleotides, at least 100 nucleotides, at least 200, at least 500, or larger.

In addition to the oligonucleotide sequences described above, homologues and orthologs of such sequences, as may, for example be present in other species, may be identified and may be readily isolated, without undue experimentation, by molecular biological techniques well known in the art, as well as use of gene analysis tools described above, and e.g., in Example 4. Further, there may exist nucleotide sequences at other genetic loci within the genome that encode proteins, which have extensive homology to one or more domains of such gene products. These nucleotide sequences may also be identified via similar techniques.

For example, the isolated differentially expressed nucleotide sequence may be labeled and used to screen a cDNA library constructed from mRNA obtained from the organism of interest. Hybridization conditions will be of a lower stringency when the cDNA library was derived from an organism different from the type of organism from which the labeled sequence was derived. Alternatively, the labeled fragment may be used to screen a genomic library derived from the organism of interest, again, using appropriately stringent conditions. Such low stringency conditions will be well known to those of skill in the art, and will vary predictably depending on the specific organisms from which the library and the labeled sequences are derived. For guidance regarding such conditions see, for example, Sambrook et al., 1989, Molecular Cloning, A Laboratory Manual, Cold Springs Harbor Press, N.Y.; and Ausubel et al., 1989, Current Protocols in Molecular Biology, Green Publishing Associates and Wiley Interscience, N.Y.

Protein Products

Novel nucleotide products include those proteins encoded by the novel nucleotide sequences described, above. Specifically, novel gene products may include polypeptides encoded by the novel nucleotide sequences contained in the coding regions of the nucleotide sequences to which DNA sequences disclosed herein (in TABLES 3A, 3B and the sequence listing).

In addition, novel protein products of novel nucleotide sequences may include proteins that represent functionally equivalent gene products. Such an equivalent novel gene product may contain deletions, additions or substitutions of amino acid residues within the amino acid sequence encoded by the novel nucleotide sequences described, above, but which result in a silent change, thus producing a functionally equivalent novel nucleotide sequence product. Amino acid substitutions may be made on the basis of similarity in polarity, charge, solubility, hydrophobicity, hydrophilicity, and/or the amphipathic nature of the residues involved.

For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. "Functionally equivalent", as utilized herein, refers to a protein capable of exhibiting a substantially similar in vivo activity as the endogenous novel gene products encoded by the novel nucleotide described, above.

The novel gene products (protein products of the novel nucleotide sequences) may be produced by recombinant DNA technology using techniques well known in the art. Methods which are well known to those skilled in the art can be used to construct expression vectors containing novel nucleotide sequence protein coding sequences and appropriate transcriptional/translational control signals. These methods include, for example, in vitro recombinant DNA techniques, synthetic techniques and in vivo recombination/genetic recombination. See, for example, the techniques described in Sambrook et al., 1989, supra, and Ausubel et al., 1989, supra. Alternatively, RNA capable of encoding novel nucleotide sequence protein sequences may be chemically synthesized using, for example, synthesizers. See, for example, the techniques described in "Oligonucleotide Synthesis", 1984, Gait, M. J. ed., IRL Press, Oxford, which is incorporated by reference herein in its entirety. A variety of host-expression vector systems may be utilized to express the novel nucleotide sequence coding sequences of the invention. (Ruther et al., 1983, EMBO J. 2:1791; Inouye & Inouye, 1985, Nucleic Acids Res. 13:3101-3109; Van Heeke & Schuster, 1989, J. Biol. Chem. 264:5503; Smith et al., 1983, J. Virol. 46: 584; Smith, U.S. Pat. No. 4,215,051; Logan & Shenk, 1984, Proc. Natl. Acad. Sci. USA 81:3655-3659; Bittner et al., 1987, Methods in Enzymol. 153:516-544; Wigler, et al., 1977, Cell 11:223; Szybalska & Szybalski, 1962, Proc. Natl. Acad. Sci. USA 48:2026; Lowy, et al., 1980, Cell 22:817; Wigler, et al., 1980, Natl. Acad. Sci. USA 77:3567; O'Hare, et al., 1981, Proc. Natl. Acad. Sci. USA 78:1527; Mulligan & Berg, 1981, Proc. Natl. Acad. Sci. USA 78:2072; Colberre-Garapin, et al., 1981, J. Mol. Biol. 150:1; Santerre, et al., 1984, Gene 30:147; Janknecht, et al., 1991, Proc. Natl. Acad. Sci. USA 88: 8972-8976

Where recombinant DNA technology is used to produce the protein encoded by the novel nucleotide sequence for such assay systems, it may be advantageous to engineer fusion proteins that can facilitate labeling, immobilization and/or detection.

Indirect labeling involves the use of a protein, such as a labeled antibody, which specifically binds to the protein encoded by the novel nucleotide sequence. Such antibodies include but are not limited to polyclonal, monoclonal, chimeric, single chain, Fab fragments and fragments produced by an Fab expression library.

Antibodies

The invention also provides for antibodies to the protein encoded by the novel nucleotide sequences. Described herein are methods for the production of antibodies capable of specifically recognizing one or more novel nucleotide sequence epitopes. Such antibodies may include, but are not limited to polyclonal antibodies, monoclonal antibodies (mAbs), humanized or chimeric antibodies, single chain antibodies, Fab fragments, F(ab')2 fragments, fragments produced by a Fab expression library, anti-idiotypic (anti-Id) antibodies, and epitope-binding fragments of any of the above. Such antibodies may be used, for example, in the detection of a novel nucleotide sequence in a biological sample, or, alternatively, as a method for the inhibition of abnormal gene activity, for example, the inhibition of a disease target nucleotide sequence, as further described below. Thus, such antibodies may be utilized as part of cardiovascular or other disease treatment method, and/or may be used as part of diagnostic techniques whereby patients may be tested for abnormal levels of novel nucleotide sequence encoded proteins, or for the presence of abnormal forms of the such proteins.

For the production of antibodies to a novel nucleotide sequence, various host animals may be immunized by injection with a novel protein encoded by the novel nucleotide sequence, or a portion thereof. Such host animals may include but are not limited to rabbits, mice, and rats, to name but a few. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (bacille Calmette-Guerin) and *Corynebacterium parvum*.

Polyclonal antibodies are heterogeneous populations of antibody molecules derived from the sera of animals immunized with an antigen, such as novel gene product, or an antigenic functional derivative thereof. For the production of polyclonal antibodies, host animals such as those described above, may be immunized by injection with novel gene product supplemented with adjuvants as also described above.

Monoclonal antibodies, which are homogeneous populations of antibodies to a particular antigen, may be obtained by any technique which provides for the production of antibody molecules by continuous cell lines in culture. These include, but are not limited to the hybridoma technique of Kohler and Milstein, (1975, Nature 256:495-497; and U.S. Pat. No. 4,376,110), the human B-cell hybridoma technique (Kosbor et al., 1983, Immunology Today 4:72; Cole et al., 1983, Proc. Natl. Acad. Sci. USA 80:2026-2030), and the EBV-hybridoma technique (Cole et al., 1985, Monoclonal Antibodies And Cancer Therapy, Alan R. Liss, Inc., pp. 77-96). Such antibodies may be of any immunoglobulin class including IgG, IgM, IgE, IgA, IgD and any subclass thereof. The hybridoma producing the mAb of this invention may be cultivated in vitro or in vivo.

In addition, techniques developed for the production of "chimeric antibodies" (Morrison et al., 1984, Proc. Natl. Acad. Sci., 81:6851-6855; Neuberger et al., 1984, Nature, 312:604-608; Takeda et al., 1985, Nature, 314:452-454) by splicing the genes from a mouse antibody molecule of appropriate antigen specificity together with genes from a human antibody molecule of appropriate biological activity can be used. A chimeric antibody is a molecule in which different portions are derived from different animal species, such as those having a variable region derived from a murine mAb and a human immunoglobulin constant region.

Alternatively, techniques described for the production of single chain antibodies (U.S. Pat. No. 4,946,778; Bird, 1988, Science 242:423-426; Huston et al., 1988, Proc. Natl. Acad. Sci. USA 85:5879-5883; and Ward et al., 1989, Nature 334: 544-546) can be adapted to produce novel nucleotide sequence-single chain antibodies. Single chain antibodies are formed by linking the heavy and light chain fragments of the Fv region via an amino acid bridge, resulting in a single chain polypeptide.

Antibody fragments which recognize specific epitopes may be generated by known techniques For example, such fragments include but are not limited to: the F(ab')2 fragments which can be produced by pepsin digestion of the antibody molecule and the Fab fragments which can be generated by reducing the disulfide bridges of the F(ab')2 fragments. Alternatively, Fab expression libraries may be constructed (Huse et al., 1989, Science, 246:1275-1281) to allow rapid and easy identification of monoclonal Fab fragments with the desired specificity.

Disease Specific Target Oligonucleotide Sequences

The invention also provides disease specific target oligonucleotide sequences, and sets of disease specific target oligonucletide-sequences. The diagnostic oligonucleotide sets, subsets thereof, novel oligonucleotide sequences, and individual members of the diagnostic oligonucleotide sets identified as described above are also disease specific target oligonucleotide sequences. In particular, individual oligonucleotide sequences that are differentially regulated or have predictive value that is strongly correlated with a disease or disease criterion are especially favorable as disease specific target oligonucleotide sequences. Sets of genes that are co-regulated may also be identified as disease specific target oligonucleotide sets. Such oligonucleotide sequences and/or oligonucleotide sequence products are targets for modulation by a variety of agents and techniques. For example, disease specific target oligonucleotide sequences (or the products of such oligonucleotide sequences, or sets of disease specific target oligonucleotide sequences) can be inhibited or activated by, e.g., target specific monoclonal antibodies or small molecule inhibitors, or delivery of the oligonucleotide sequence or gene product of the oligonucleotide sequence to patients. Also, sets of genes can be inhibited or activated by a variety of agents and techniques. The specific usefulness of the target oligonucleotide sequence(s) depends on the subject groups from which they were discovered, and the disease or disease criterion with which they correlate.

Kits

The present invention is optionally provided to a user as a kit. Typically, a kit contains one or more diagnostic nucleotide sets of the invention. Alternatively, the kit contains the candidate nucleotide library of the invention. Most often, the kit contains a diagnostic nucleotide probe set, or other subset of a candidate library, (e.g., as a cDNA, oligonucleotide or antibody microarray or reagents for performing an assay on a diagnostic gene set using any expression profiling technology), packaged in a suitable container. The kit may further comprise, one or more additional reagents, e.g., substrates, labels, primers, for labeling expression products, tubes and/or other accessories, reagents for collecting blood samples, buffers, e.g., erythrocyte lysis buffer, leukocyte lysis buffer, hybridization chambers, cover slips, etc., as well as a software package, e.g., including the statistical methods of the invention, e.g., as described above, and a password and/or account number for accessing the compiled database. The kit optionally further comprises an instruction set or user manual detailing preferred methods of using the diagnostic nucleotide sets in the methods of the invention.

This invention will be better understood by reference to the following non-limiting Examples:

EXAMPLES

Example 1

Generation of subtracted leukocyte candidate nucleotide library

Example 2

Identification of nucleotide sequences for candidate library using data mining techniques

Example 3

DNA Sequencing and Processing of raw sequence data.

Example 4

Further sequence analysis of novel nucleotide sequences identified by subtractive hybridization screening

Example 5

Further sequence analysis of novel Clone 596H6

Example 6

Further sequence analysis of novel Clone 486E11

Example 7

Preparation of RNA from mononuclear cells for expression profiling

Example 8

Preparation of Universal Control RNA for use in leukocyte expression profiling

Example 9

Identification of diagnostic oligonucleotide sets for use in diagnosis of rheumatoid arthritis.

Example 10

Identification of diagnostic oligonucleotide sets for diagnosis of Systemic Lupus Erythematosis

Example 11

Probe selection for a 24,000 feature Array.

Example 12

Design of oligonucleotide probes.

Example 13

Production of an array of 8,000 spotted 50 mer oligonucleotides.

Example 14

Amplification, labeling and hybridization of total RNA to an oligonucleotide microarray.

Example 15

Real-time PCR validation of array expression results

Example 16

Correlation and classification analysis

EXAMPLES

Example 1

Generation of Subtracted Leukocyte Candidate Nucleotide Library

To produce a candidate nucleotide library with representatives from the spectrum of nucleotide sequences that are differentially expressed in leukocytes, subtracted hybridization libraries were produced from the following cell types and conditions:
1. Buffy Coat leukocyte fractions—stimulated with ionomycin and PMA
2. Buffy Coat leukocyte fractions—un-stimulated
3. Peripheral blood mononuclear cells—stimulated with ionomycin and PMA
4. Peripheral blood mononuclear cells—un-stimulated
5. T lymphocytes—stimulated with PMA and ionomycin
6. T lymphocytes—resting Cells were obtained from multiple individuals to avoid introduction of bias by using only one person as a cell source.

Buffy coats (platelets and leukocytes that are isolated from whole blood) were purchased from Stanford Medical School Blood Center. Four buffy coats were used, each of which was derived from about 350 ml of whole blood from one donor individual 10 ml of buffy coat sample was drawn from the sample bag using a needle and syringe. 40 ml of Buffer EL (Qiagen) was added per 10 ml of buffy coat to lyse red blood cells. The sample was placed on ice for 15 minutes, and cells were collected by centrifugation at 2000 rpm for 10 minutes. The supernatant was decanted and the cell pellet was re-suspended in leukocyte growth media supplemented with DNase (LGM-3 from Clonetics supplemented with Dnase at a final concentration of 30 U/ml). Cell density was determined using a hemocytometer. Cells were plated in media at a density of $1 \times 10^6$ cells/ml in a total volume of 30 ml in a T-75 flask (Corning). Half of the cells were stimulated with ionomycin and phorbol myristate acetate (PMA) at a final concentration of 1 μg/ml and 62 ng/ml, respectively. Cells were incubated at 37° C. and at 5% $CO_2$ for 3 hours, then cells were scraped off the flask and collected into 50 ml tubes. Stimulated and resting cell populations were kept separate. Cells were centrifuged at 2000 rpm for 10 minutes and the supernatant was removed. Cells were lysed in 6 ml of phenol/guanidine isothyocyanate (Trizol reagent, GibcoBRL), homogenized using a rotary homogenizer, and frozen at 80°. Total RNA and mRNA were isolated as described below.

Two frozen vials of $5 \times 10^6$ pooled human peripheral blood mononuclear cells (PBMCs) were purchased from Clonetics (catalog number cc-2702). The cells were rapidly thawed in a 37° C. water bath and transferred to a 15 ml tube containing 10 ml of leukocyte growth media supplemented with DNase (prepared as described above). Cells were centrifuged at 200

μg for 10 minutes. The supernatant was removed and the cell pellet was resuspended in LGM-3 media supplemented with DNase. Cell density was determined using a hemocytometer. Cells were plated at a density of $1 \times 10^6$ cells/ml in a total volume of 30 ml in a T-75 flask (Corning). Half of the cells were stimulated with ionomycin and PMA at a final concentration of 1 μg/ml and 62 ng/ml, respectively. Cells were incubated at 37° C. and at 5% $CO_2$ for 3 hours, then cells were scraped off the flask and collected into 50 ml tubes. Stimulated and resting cell populations were kept separate. Cells were centrifuged at 2000 rpm and the supernatant was removed. Cells were lysed in 6 ml of phenol/guanidine isothyocyanate solution (TRIZOL reagent, GibcoBRL)), homogenized using a rotary homogenizer, and frozen at 80°. Total RNA and mRNA were isolated from these samples using the protocol described below.

45 ml of whole blood was drawn from a peripheral vein of four healthy human subjects into tubes containing anticoagulant. 50 μl RosetteSep (Stem Cell Technologies) T-cell isolation cocktail per ml of blood was added, mixed well, and incubated for 20 minutes at room temperature. The mixture was diluted with an equal volume of PBS+2% fetal bovine serum (FBS) and mixed by inversion. 30 ml of diluted mixture sample was layered on top of 15 ml DML medium (Stem Cell Technologies). The sample tube was centrifuged for 20 minutes at 1200×g at room temperature. The enriched T-lymphocyte cell layer at the plasma: medium interface was removed. Enriched cells were washed with PBS+2% FBS and centrifuged at 1200×g. The cell pellet was treated with 5 ml of erythrocyte lysis buffer (EL buffer, Qiagen) for 10 minutes on ice. The sample was centrifuged for 5 min at 1200 g. Cells were plated at a density of $1 \times 10^6$ cells/ml in a total volume of 30 ml in a T-75 flask (Corning). Half of the cells were stimulated with ionomycin and PMA at a final concentration of 1 μg/ml and 62 ng/ml, respectively. Cells were incubated at 37° C. and at 5% $CO_2$ for 3 hours, then cells were scraped off the flask and collected into 50 ml tubes. Stimulated and resting cell populations were kept separate. Cells were centrifuged at 2000 rpm and the supernatant was removed. Cells were lysed in 6 ml of phenol/guanidine isothyocyanate solution (TRIZOL reagent, GibcoBRL), homogenized using a rotary homogenizer, and frozen at 80°. Total RNA and mRNA were isolated as described below.

Total RNA and mRNA were isolated using the following procedure: the homogenized samples were thawed and mixed by vortexing. Samples were lysed in a 1:0.2 mixture of Trizol and chloroform, respectively. For some samples, 6 ml of Trizol-chloroform was added. Variable amounts of Trizol-chloroform was added to other samples. Following lysis, samples were centrifuged at 3000 g for 15 min at 4° C. The aqueous layer was removed into a clean tube and 4 volumes of Buffer RLT Qiagen) was added for every volume of aqueous layer. The samples were mixed thoroughly and total RNA was prepared from the sample by following the Qiagen Rneasy midi protocol for RNA cleanup (October 1999 protocol, Qiagen). For the final step, the RNA was eluted from the column twice with 250 μl Rnase-free water. Total RNA was quantified using a spectrophotometer. Isolation of mRNA from total RNA sample was done using The Oligotex mRNA isolation protocol (Qiagen) was used to isolate mRNA from total RNA, according to the manufacturer's instructions (Qiagen, 7/99 version). mRNA was quantified by spectrophotometry.

Subtracted cDNA libraries were prepared using Clontech's PCR-Select cDNA Subtraction Kit (protocol number PT-1117-1) as described in the manufacturer's protocol. The protocol calls for two sources of RNA per library, designated "Driver" and "Tester." The following 6 libraries were made:

| Library | Driver RNA | Tester RNA |
|---|---|---|
| Buffy Coat Stimulated | Un-stimulated Buffy Coat | Stimulated Buffy Coat |
| Buffy Coat Resting | Stimulated Buffy Coat | Un-stimulated Buffy Coat |
| PBMC Stimulated | Un-stimulated PBMCs | Stimulated PBMCs |
| PBMC Resting | Stimulated PBMCs | Un-stimulated PBMCs |
| T-cell Stimulated | Un-stimulated T-cells | Stimulated T-cells |
| T-cell Resting | Stimulated T-cells | Un-stimulated T-cells |

The Clontech protocol results in the PCR amplification of cDNA products. The PCR products of the subtraction protocol were ligated to the pGEM T-easy bacterial vector as described by the vector manufacturer (Promega 6/99 version). Ligated vector was transformed into competent bacteria using well-known techniques, plated, and individual clones are picked, grown and stored as a glycerol stock at −80 C. Plasmid DNA was isolated from these bacteria by standard techniques and used for sequence analysis of the insert. Unique cDNA sequences were searched in the Unigene database (build 133), and Unigene cluster numbers were identified that corresponded to the DNA sequence of the cDNA. Unigene cluster numbers were recorded in an Excel spreadsheet.

Example 2

Identification of Nucleotide Sequences for Candidate Library Using Data Mining Techniques Existing and publicly available gene sequence databases were used to identify candidate nucleotide sequences for leukocyte expression profiling. Genes and nucleotide sequences with specific expression in leukocytes, for example, lineage specific markers, or known differential expression in resting or activated leukocytes were identified. Such nucleotide sequences are used in a leukocyte candidate nucleotide library, alone or in combination with nucleotide sequences isolated through cDNA library construction, as described above.

Leukocyte candidate nucleotide sequences were identified using three primary methods. First, the publically accessible publication database PubMed was searched to identify nucleotide sequences with known specific or differential expression in leukocytes. Nucleotide sequences were identified that have been demonstrated to have differential expression in peripheral blood leukocytes between subjects with and without particular disease(s) selected from Table 1. Additionally, genes and gene sequences that were known to be specific or selective for leukocytes or sub-populations of leukocytes were identified in this way.

Next, two publicly available databases of DNA sequences, Unigene located on the website at ncbi.nlm.nih.gov/UniGene and BodyMap located on the website at bodymap.ims.u-tokyo.ac.jp, were searched for sequenced DNA clones that showed specificity to leukocyte lineages, or subsets of leukocytes, or resting or activated leukocytes.

The human Unigene database (build 133) was used to identify leukocyte candidate nucleotide sequences that were likely to be highly or exclusively expressed in leukocytes. We used the Library Differential Display utility of Unigene located on the website at ncbi.nlm.nih.gov/UniGene/info/ ddd.html, which uses statistical methods (The Fisher Exact Test) to identify nucleotide sequences that have relative specificity for a chosen library or group of libraries relative to each other. We compared the following human libraries from Unigene release 133:

| | | |
|---|---|---|
| 546 | NCI_CGAP_HSC1 (399) | |
| 848 | Human_mRNA_from_cd34+_stem_cells (122) | |
| 105 | CD34+DIRECTIONAL (150) | |
| 3587 | KRIBB_Human_CD4 intrathymic T-cell_cDNA library (134) | |
| 3586 | KRIBB_Human_DP_intrathymic T-cell_cDNA library (179) | |
| 3585 | KRIBB_Human_TN_intrathymic T-cell_cDNA library (127) | |
| 3586 | 323 Activated_T-cells_I (740) | |
| 376 | Activated_T-cells_XX (1727) | |
| 327 | Monocytes,_stimulated_II (110) | |
| 824 | Proliferating_Erythroid_Cells_(LCB:ad_library) (665) | |
| 825 | 429 Macrophage_II (105) | |
| 387 | Macrophage_I (137) | |
| 669 | NCI_CGAP_CLL1 (11626) | |
| 129 | Human_White_blood_cells (922) | |
| 1400 | NIH_MGC_2 (422) | |
| 55 | Human_promyelocyte (1220) | |
| 1010 | NCI_CGAP_CML1 (2541) | |
| 2217 | NCI_CGAP_Sub7 (218) | |
| 1395 | NCI_CGAP_Sub6 (2764) | |
| 4874 | NIH_MGC_48 (2524) | |

Sequences from these libraries were compared to sequences from non-leukocyte derived libraries in the Unigene database to identify genes that had some specificity for the leukocyte-derived libraries.

BodyMap, like Unigene, contains cell-specific libraries that contain potentially useful information about genes that may serve as lineage-specific or leukocyte specific markers (Okubo et al. 1992). We compared three leukocyte specific libraries, Granulocyte, CD4 T cell, and CD8 T cell, with the other libraries. Nucleotide sequences that were found in one or more of the leukocyte-specific libraries, but absent in the other, were identified. Clones that were found exclusively in one of the three leukocyte libraries were also included in a list of nucleotide sequences that could serve as lineage-specific markers.

Next, the sequence of the nucleotide sequences identified in PubMed or BodyMap were searched in Unigene (version 133), and a human Unigene cluster number was identified for each nucleotide sequence. The cluster number was recorded in a Microsoft Excel™ spreadsheet, and a non-redundant list of these clones was made by sorting the clones by UniGene number, and removing all redundant clones using Microsoft Excel™ tools. The non-redundant list of UniGene cluster numbers was then compared to the UniGene cluster numbers of the cDNAs identified using subtractive cDNA hybridization, as described above in Example 1 (listed in Table 3 and the sequence listing). Only UniGene clusters that were not contained in the cDNA libraries were retained. Unigene clusters corresponding to 1911 candidate nucleotide sequences for leukocyte expression profiling were identified in this way and are listed in Table 3 and the sequence listing.

DNA clones corresponding to each UniGene cluster number are obtained in a variety of ways. First, a cDNA clone with identical sequence to part of, or all of the identified UniGene cluster is bought from a commercial vendor or obtained from the IMAGE consortium located on the web at image.llnl.gov/, the Integrated Molecular Analysis of Genomes and their Expression. Alternatively, PCR primers are designed to amplify and clone any portion of the nucleotide sequence from cDNA or genomic DNA using well-known techniques. Alternatively, the sequences of the identified UniGene clusters are used to design and synthesize oligonucleotide probes for use in oligonucleotide microarray based expression profiling.

Example 3

DNA Sequencing and Processing of Raw Sequence Data

Clones of differentially expressed cDNAs (identified by subtractive hybridization, described above) were sequenced on an MJ Research BaseStation™ slab gel based fluorescent detection system, using BigDye™ (Applied Biosystems, Foster City, Calif.) terminator chemistry was used (Heiner et al., Genome Res 1998 May; 8(5):557-61).

The fluorescent profiles were analyzed using the Phred sequence analysis program (Ewing et al, (1998), Genome Research 8: 175-185). Analysis of each clone results in a one pass nucleotide sequence and a quality file containing a number for each base pair with a score based on the probability that the determined base is correct. Each of the sequence files and its respective quality files were initially combined into single fasta format (Pearson, W R. Methods Mol Biol. 2000; 132:185-219), multi-sequence file with the appropriate labels for each clone in the headers for subsequent automated analysis.

Initially, known sequences were analyzed by pair wise similarity searching using the blastn option of the blastall program obtained from the National Center for Biological Information, National Library of Medicine, National Institutes of Health (NCBI) to determine the quality score that produced accurate matching (Altschul S F, et al. J Mol Biol. 1990 Oct. 5; 215(3):403-10.). Empirically, it was determined that a raw score of 8 was the minimum that contained useful information. Using a sliding window average for 16 base pairs, an average score was determined. The sequence was removed (trimmed) when the average score fell below 8. Maximum reads were 950 nucleotides long.

Next, the sequences were compared by similarity matching against a database file containing the flanking vector sequences used to clone the cDNA, using the blastall program with the blastn option. All regions of vector similarity were removed, or "trimmed" from the sequences of the clones using scripts in the GAWK programming language, a variation of AWK (Aho A V et al, The Awk Programming Language (Addison-Wesley, Reading Mass., 1988); Robbins, A D, "Effective AWK Programming" (Free Software Foundation, Boston Mass., 1997). It was found that the first 45 base pairs of all the sequences were related to vector; these sequences were also trimmed and thus removed from consideration. The remaining sequences were then compared against the NCBI vector database (Kitts, P. A. et al. National Center for Biological Information, National Library of Medicine, National Institutes of Health, Manuscript in preparation (2001) using blastall with the blastn option. Any vector sequences that were found were removed from the sequences.

Messenger RNA contains repetitive elements that are found in genomic DNA. These repetitive elements lead to false positive results in similarity searches of query mRNA sequences versus known mRNA and EST databases. Additionally, regions of low information content (long runs of the same nucleotide, for example) also result in false positive results. These regions were masked using the program RepeatMasker2 found on the website at repeatmasker.genome.washington.edu (Smit, A F A & Green, P "RepeatMasker" at the website at genome.washington.edu/RM/RepeatMasker.html. The trimmed and masked files were then subjected to further sequence analysis.

Example 4

Further Sequence Analysis of Novel Nucleotide Sequences Identified by Subtractive Hybridization Screening cDNA sequences were further characterized using BLAST analysis. The BLASTN program was used to compare the sequence of the fragment to the UniGene, dbEST, and nr databases at NCBI (Genbank release 123.0; see Table 5). In the BLAST algorithm, the expect value for an alignment is used as the measure of its significance. First, the cDNA sequences were compared to sequences in Unigene on the web at ncbi.nlm.nih.gov/UniGene. If no alignments were found with an expect value less than $10^{-25}$, the sequence was compared to the sequences in the dbEST database using BLASTN. If no alignments were found with an expect value less than $10^{-25}$, the sequence was compared to sequences in the nr database.

The BLAST analysis produced the following categories of results: a) a significant match to a known or predicted human gene, b) a significant match to a nonhuman DNA sequence, such as vector DNA or *E. coli* DNA, c) a significant match to an unidentified GenBank entry (a sequence not previously identified or predicted to be an expressed sequence or a gene), such as a cDNA clone, mRNA, or cosmid, or d) no significant alignments. If a match to a known or predicted human gene was found, analysis of the known or predicted protein product was performed as described below. If a match to an unidentified GenBank entry was found, or if no significant alignments were found, the sequence was searched against all known sequences in the human genome database located on the web at ncbi.nlm.nih.gov/genome/seq/page.cgi?F=HsBlast.html&&ORG=Hs, see Table 5.

If many unknown sequences were to be analyzed with BLASTN, the clustering algorithm CAP2 (Contig Assembly Program, version 2) was used to cluster them into longer, contiguous sequences before performing a BLAST search of the human genome. Sequences that can be grouped into contigs are likely to be cDNA from expressed genes rather than vector DNA, *E. coli* DNA or human chromosomal DNA from a noncoding region, any of which could have been incorporated into the library. Clustered sequences provide a longer query sequence for database comparisons with BLASTN; increasing the probability of finding a significant match to a known gene. When a significant alignment was found, further analysis of the putative gene was performed, as described below. Otherwise, the sequence of the original cDNA fragment or the CAP2 contig is used to design a probe for expression analysis and further approaches are taken to identify the gene or predicted gene that corresponds to the cDNA sequence, including similarity searches of other databases, molecular cloning, and Rapid Amplification of cDNA Ends (RACE).

In some cases, the process of analyzing many unknown sequences with BLASTN was automated by using the BLAST network-client program blastcl3, which was downloaded from ftp://ncbi.nlm.nih.gov/blast/network/netblast.

When a cDNA sequence aligned to the sequence of one or more chromosomes, a large piece of the genomic region around the loci was used to predict the gene containing the cDNA. To do this, the contig corresponding to the mapped locus, as assembled by the RefSeq project at NCBI, was downloaded and cropped to include the region of alignment plus 100,000 bases preceding it and 100,000 bases following it on the chromosome. The result was a segment 200 kb in length, plus the length of the alignment. This segment, designated a putative gene, was analyzed using an exon prediction algorithm to determine whether the alignment area of the unknown sequence was contained within a region predicted to be transcribed (see Table 6).

This putative gene was characterized as follows: all of the exons comprising the putative gene and the introns between them were taken as a unit by noting the residue numbers on the 200 kb+ segment that correspond to the first base of the first exon and the last base of the last exon, as given in the data returned by the exon prediction algorithm. The truncated sequence was compared to the UniGene, dbEST, and nr databases to search for alignments missed by searching with the initial fragment.

The predicted amino acid sequence of the gene was also analyzed. The peptide sequence of the gene predicted from the exons was used in conjunction with numerous software tools for protein analysis (see Table 7). These were used to classify or identify the peptide based on similarities to known proteins, as well as to predict physical, chemical, and biological properties of the peptides, including secondary and tertiary structure, flexibility, hydrophobicity, antigenicity (hydrophilicity), common domains and motifs, and localization within the cell or tissues. The peptide sequence was compared to protein databases, including SWISS-PROT, TrEMBL, GenPept, PDB, PIR, PROSITE, ProDom, PROSITE, Blocks, PRINTS, and Pfam, using BLASTP and other algorithms to determine similarities to known proteins or protein subunits.

Example 5

Further Sequence Analysis of Novel Clone 596H6

The sequence of clone 596H6 is provided below:

```
                                         (SEQ ID NO: 8767)
ACTATATTTA GGCACCACTG CCATAAACTA CCAAAAAAAA       50
AATGTAATTC

CTAGAAGCTG TGAAGAATAG TAGTGTAGCT AAGCACGGTG      100
TGTGGACAGT

GGGACATCTG CCACCTGCAG TAGGTCTCTG CACTCCCAAA      150
AGCAAATTAC

ATTGGCTTGA ACTTCAGTAT GCCCGGTTCC ACCCTCCAGA      200
AACTTTTGTG

TTCTTTGTAT AGAATTTAGG AACTTCTGAG GGCCACAAAT      250
ACACACATTA

AAAAAGGTAG AATTTTTGAA GATAAGATTC TTCTAAAAAA      300
GCTTCCCAAT

GCTTGAGTAG AAAGTATCAG TAGAGGTATC AAGGGAGGAG      350
AGACTAGGTG

ACCACTAAAC TCCTTCAGAC TCTTAAAATT ACGATTCTTT      400
TCTCAAAGGG

GAAGAACGTC AGTGCAGCGA TCCCTTCACC TTTAGCTAAA      450
GAATTGGACT

GTGCTGCTCA AAATAAAGAT CAGTTGGAGG TANGATGTCC      500
AAGACTGAAG

GTAAAGGACT AGTGCAAACT GAAAGTGATG GGGAAACAGA      550
CCTACGTATG
```

-continued
```
GAAGCCATGT AGTGTTCTTC ACAGGCTGCT GTTGACTGAA        600
ATTCCTATCC

TCAAATTACT CTAGACTGAA GCTGCTTCCC TTCAGTGAGC        650
AGCCTCTCCT

TCCAAGATTC TGGAAAGCAC ACCTGACTCC AAACAAAGAC        700
TTAGAGCCCT

GTGTCAGTGC TGCTGCTGCT TTTACCAGAT TCTCTAACCT        750
TCCGGGTAGA

AGAG
```

This sequence was used as input for a series of BLASTN searches. First, it was used to search the UniGene database, build 132 located on the web at ncbi.nlm.nih.gov/BLAST. No alignments were found with an expect value less than the threshold value of $10^{-25}$. A BLASTN search of the database dbEST, release 041001, was then performed on the sequence and 21 alignments were found (http://www.ncbi.nlm.nih.gov/BLAST/). Ten of these had expect values less than 10-25, but all were matches to unidentified cDNA clones. Next, the sequence was used to run a BLASTN search of the nr database, release 123.0. No significant alignment to any sequence in nr was found. Finally, a BLASTN search of the human genome was performed on the sequence located on the web at ncbi.nlm.nih.gov/genome/seq/page.cgi?F=HsBlast.html&&ORG=Hs.

A single alignment to the genome was found on contig NT_004698.3 (e=0.0). The region of alignment on the contig was from base 1,821,298 to base 1,822,054, and this region was found to be mapped to chromosome 1, from base 105,552,694 to base 105,553,450. The sequence containing the aligned region, plus 100 kilobases on each side of the aligned region, was downloaded. Specifically, the sequence of chromosome 1 from base 105,452,694 to 105,653,450 was downloaded from the website at ncbi.nlm.nih.gov/cgi-bin/Entrez/seq_reg.cgi?chr=1 &from=105452694&to=105653450.

This 200,757 bp segment of the chromosome was used to predict exons and their peptide products as follows. The sequence was used as input for the Genscan algorithm located on the web at genes.mit.edu/GENSCAN.html, using the following Genscan settings:
  Organism: vertebrate
  Suboptimal exon cutoff: 1.00 (no suboptimal exons)
  Print options: Predicted CDS and peptides The region matching the sequence of clone 596H6 was known to span base numbers 100,001 to 100,757 of the input sequence. An exon was predicted by the algorithm, with a probability of 0.695, covering bases 100,601 to 101,094 (designated exon 4.14 of the fourth predicted gene). This exon was part of a predicted cistron that is 24,195 bp in length. The sequence corresponding to the cistron was noted and saved separately from the 200,757 bp segment. BLASTN searches of the Unigene, dbEST, and nr databases were performed on it.

At least 100 significant alignments to various regions of the sequence were found in the dbEST database, although most appeared to be redundant representations of a few exons. All matches were to unnamed cDNAs and mRNAs (unnamed cDNAs and mRNAs are cDNAs and mRNAs not previously identified, or shown to correspond to a known or predicted human gene) from various tissue types. Most aligned to a single region on the sequence and spanned 500 bp or less, but several consisted of five or six regions separated by gaps, suggesting the locations of exons in the gene. Several significant matches to entries in the UniGene database were found, as well, even after masking low-complexity regions and short repeats in the sequence. All matches were to unnamed cDNA clones.

At least 100 significant alignments were found in the nr database, as well. A similarity to hypothetical protein FLJ22457 (UniGene cluster Hs.238707) was found (e=0.0). The cDNA of this predicted protein has been isolated from B lymphocytes located on the web at ncbi.nlm.nih.gov/entrez/viewer.cgi?save=0&cmd=&cfm=on&f=1 & view=gp&txt=0&val=13637988.

Other significant alignments were to unnamed cDNAs and mRNAs.

Using Genscan, the following 730 residue peptide sequence was predicted from the putative gene:

```
                                              SEQ ID NO: 8768
MDGLGRRLRA SLRLKRGHGG HWRLNEMPYM KHEFDGGPPQ         50
DNSGEALKEP

ERAQEHSLPN FAGGQHFFEY LLVVSLKKKR SEDDYEPIIT        100
YQFPKRENLL

RGQQEEEERL LKAIPLFCFP DGNEWASLTE YPSLSCKTPG        150
LLAALVVEKA

QPRTCCHASA PSAAPQARGP DAPSPAAGQA LPAGPGPRLP        200
KVYCIISCIG

CFGLFSKILD EVEKRHQISM AVIYPFMQGL REAAFPAPGK        250
TVTLKSFIPD

SGTEFISLTR PLDSHLEHVD FSSLLHCLSF EQILQIFASA        300
VLERKIIFLA

EGLREEEKDV RDSTEVRGAG ECHGFQRKGN LGKQWGLCVE        350
DSVKMGDNQR

GTSCSTLSQC IHAAAALLYP FSWAHTYIPV VPESLLATVC        400
CPTPFMVGVQ

MRFQQEVMDS PMEEIQPQAE IKTVNPLGVY EERGPEKASL        450
CLFQVLLVNL

CEGTFLMSVG DEKDILPPKL QDDILDSLGQ GINELKTAEQ        500
INEHVSGPFV

QFFVKIVGHY ASYIKREANG QGHFQERSFC KALTSKTNRR        550
FVKKFVKTQL

FSLFIQEAEK SKNPPAEVTQ VGNSSTCVVD TWLEAAATAL        600
SHHYNIFNTE

HTLWSKGSAS LHEVCGHVRT RVKRKILFLY VSLAFTMGKS        650
IFLVENKAMN

MTIKWTTSGR PGHGDMFGVI ESWGAAALLL LTGRVRDTGK        700
SSSSTGHRAS

KSLVWSQVCF PESWEERLLT EGKQLQSRVI
```

Multiple analyses were performed using this prediction. First, a pairwise comparison of the sequence above and the sequence of FLJ22457, the hypothetical protein mentioned above, using BLASTP version 2.1.2 located on the web at ncbi.nlm.nih.gov/BLAST, resulted in a match with an expect value of 0.0. The peptide sequence predicted from clone 596H6 was longer and 19% of the region of alignment between the two resulted from gaps in hypothetical protein FLJ22457. The cause of the discrepancy might be alternative mRNA splicing, alternative post-translational processing, or differences in the peptide-predicting algorithms used to create the two sequences, but the homology between the two is significant.

BLASTP and TBLASTN were also used to search for sequence similarities in the SWISS-PROT, TrEMBL, Gen- Bank Translated, and PDB databases. Matches to several proteins were found, among them a tumor cell suppression protein, HTS1. No matches aligned to the full length of the peptide sequence, however, suggesting that similarity is limited to a few regions of the peptide.

TBLASTN produced matches to several proteins—both identified and theoretical—but again, no matches aligned to the full length of the peptide sequence. The best alignment was to the same hypothetical protein found in GenBank before (FLJ22457).

To discover similarities to protein families, comparisons of the domains (described above) were carried out using the Pfam and Blocks databases. A search of the Pfam database identified two regions of the peptide domains as belonging the DENN protein family (e=2.1×10$^{-33}$). The human DENN protein possesses an RGD cellular adhesion motif and a leucine-zipper-like motif associated with protein dimerization, and shows partial homology to the receptor binding domain of tumor necrosis factor alpha. DENN is virtually identical to MADD, a human MAP kinase-activating death domain protein that interacts with type I tumor necrosis factor receptor located on the web at srs.ebi.ac.uk/srs6bin/cgi-bin/wgetz?-id+fS5n1GQsHf+-e+[INTERPRO:'IPR001194']. The search of the Blocks database also revealed similarities between regions of the peptide sequence and known protein groups but none with a satisfactory degree of confidence. In the Blocks scoring system, scores over 1,100 are likely to be relevant. The highest score of any match to the predicted peptide was 1,058.

The Prosite, ProDom, PRINTS databases (all publicly available) were used to conduct further domain and motif analysis. The Prosite search generated many recognized protein domains. A BLASTP search was performed to identify areas of similarity between the protein query sequence and PRINTS, a protein database of protein fingerprints, groups of motifs that together form a characteristic signature of a protein family. In this case, no groups were found to align closely to any section of the submitted sequence. The same was true when the ProDom database was searched with BLASTP.

A prediction of protein structure was done by performing a BLAST search of the sequence against PDB, a database in which every member has tertiary structure information. No significant alignments were found by this method. Secondary and super-secondary structure was examined using the Garnier algorithm. Although it is only considered to be 60-65% accurate, the algorithm provided information on the locations and lengths of alpha-helices, beta-sheets, turns and coils.

The antigenicity of the predicted peptide was modeled by graphing hydrophilicity vs. amino acid number. This produced a visual representation of trends in hydrophilicity along the sequence. Many locations in the sequence showed antigenicity and five sites had antigenicity greater than 2. This information can be used in the design of affinity reagents to the protein.

Membrane-spanning regions were predicted by graphing hydrophobicity vs. amino acid number. Thirteen regions were found to be somewhat hydrophobic. The algorithm TMpred predicted a model with 6 strong transmembrane helices located on the web at ch.embnet.org/software/TMPRED_form.html.

NNPSL is a neural network algorithm developed by the Sanger Center. It uses amino acid composition and sequence to predict cellular location. For the peptide sequence submitted, its first choice was mitochondrial (51.1% expected accuracy). Its second choice was cytoplasmic (91.4% expected accuracy).

Example 6

Further Sequence Analysis of Novel Clone 486E11

The sequence of clone 486E11 is provided below:

```
                                             SEQ ID NO: 8769
TAAAAGCAGG CTGTGCACTA GGGACCTAGT GACCTTACTA        50
GAAAAAACTC

AAATTCTCTG AGCCACAAGT CCTCATGGGC AAAATGTAGA       100
TACCACCACC

TAACCCTGCC AATTTCCTAT CATTGTGACT ATCAAATTAA       150
ACCACAGGCA

GGAAGTTGCC TTGAAAACTT TTTATAGTGT ATATTACTGT       200
TCACATAGAT

NAGCAATTAA CTTTACATAT ACCCGTTTTT AAAAGATCAG       250
TCCTGTGATT

AAAAGTCTGG CTGCCCTAAT TCACTTCGAT TATACATTAG       300
GTTAAAGCCA

TATAAAAGAG GCACTACGTC TTCGGAGAGA TGAATGGATA       350
TTACAAGCAG

TAATGTTGGC TTTGGAATAT ACACATAATG TCCACTTGAC       400
CTCATCTATT

TGACACAAAA TGTAAACTAA ATTATGAGCA TCATTAGATA       450
CCTTGGCCTT

TTCAAATCAC ACAGGGTCCT AGATCTNNNN NNNNNNNNNN       500
NNNNNNNNNN

NNNNNNNNNN NNNNNNNNNN NNNNNNNNNN NNNNNNNNAC       550
TTTGGGATTC

CTATATCTTT GTCAGCTGTC AACTTCAGTG TTTTCAGGTT       600
AAATTCTATC

CATAGTCATC CCAATATACC TGCTTTAGAT GATACAACCT       650
TCAAAAGATC

CGCTCTTCCT CGTAAAAAGT GGAG
```

The BLASTN program was used to compare the sequence to the UniGene and dbEST databases. No significant alignments were found in either. It was then searched against the nr database and only alignments to unnamed genomic DNA clones were found.

CAP2 was used to cluster a group of unknowns, including clone 486E11. The sequence for 486E11 was found to overlap others. These formed a contig of 1,010 residues, which is shown below:

```
                                             SEQ ID NO: 8832
CGGACAGGTA CCTAAAAGCA GGCTGTGCAC TAGGGACCTA        50
GTGACCTTAC

TAGAAAAAAC TCAAATTCTC TGAGCCACAA GTCCTCATGG       100
GCAAAATGTA

GATACCACCA CCTAACCCTG CCAATTTCCT ATCATTGTGA       150
CTATCAAATT

AAACCACAGG CAGGAAGTTG CCTTGAAAAC TTTTTATAGT       200
GTATATTACT

GTTCACATAG ATNAGCAATT AACTTTACAT ATACCCGTTT       250
TTAAAAGATC
```

```
                                           -continued
AGTCCTGTGA TTAAAAGTCT GGCTGCCCTA ATTCACTTCG      300
ATTATACATT

AGGTTAAAGC CATATAAAAG AGGCACTACG TCTTCGGAGA      350
GATGAATGGA

TATTACAAGC AGTAATTTTG GCTTTGGAAT ATACACATAA      400
TGTCCACTTG

ACCTCATCTA TTTGACACAA AATGTAAACT AAATTATGAG      450
CATCATTAGA

TACCTTGGGC CTTTTCAAAT CACACAGGGT CCTAGATCTG      500
NNNNNNNNNN

NNNNNNNNNN NNNNNNNNNN NNNNNNNNNN NNNNNNNNNN      550
NNNNNNNNNN

NACTTTGGAT TCTTATATCT TTGTCAGCTG TCAACTTCAG      600
TGTTTTCAGG

NTAAATTCTA TCCATAGTCA TCCCAATATA CCTGCTTTAG      650
ATGATACAAA

CTTCAAAAGA TCCGGCTCTC CCTCGTAAAA CGTGGAGGAC      700
AGACATCAAG

GGGGTTTTCT GAGTAAAGAA AGGCAACCGC TCGGCAAAAA      750
CTCACCCTGG

CACAACAGGA NCGAATATAT ACAGACGCTG ATTGAGCGTT      800
TTGCTCCATC

TTCACTTCTG TTAAATGAAG ACATTGATAT CTAAAATGCT      850
ATGAGTCTAA

CTTTGTAAAA TTAAAATAGA TTTGTAGTTA TTTTTCAAAA      900
TGAAATCGAA

AAGATACAAG TTTTGAAGGC AGTCTCTTTT TCCACCCTGC      950
CCCTCTAGTG

TGTTTTACAC ACTTCTCTGG CCACTCCAAC AGGGAAGCTG     1000
GTCCAGGGCC

ATTATACAGG
```

The sequence of the CAP2 contig was used in a BLAST search of the human genome. 934 out of 1,010 residues aligned to a region of chromosome 21. A gap of 61 residues divided the aligned region into two smaller fragments. The sequence of this region, plus 100 kilobases on each side of it, was downloaded and analyzed using the Genscan site at MIT located on the web at genes.mit.edu/GENSCAN.html, with the following settings:

Organism: vertebrate
Suboptimal exon cutoff: 1.00 (no suboptimal exons)
Print options: Predicted CDS and peptides The fragment was found to fall within one of several predicted genes in the chromosome region. The bases corresponding to the predicted gene, including its predicted introns, were saved as a separate file and used to search GenBank again with BLASTN to find any ESTs or UniGene clusters identified by portions of the sequence not included in the original unknown fragment. The nr database contained no significant matches. At least 100 significant matches to various parts of the predicted gene were found in the dbEST database, but all of them were to unnamed cDNA clones. Comparison to UniGene produced fewer significant matches, but all matches were to unnamed cDNAs.

The peptide sequence predicted by Genscan was also saved. Multiple types of analyses were performed on it using the resources mentioned in Table 3. BLASTP and TBLASTN were used to search the TrEMBL protein database located on the web at expasy.ch/sprot/) and the GenBank nr database located on the web at ncbi.nlm.nih.gov/BLAST, which includes data from the SwissProt, PIR, PRF, and PDB databases. No significant matches were found in any of these, so no gene identity or tertiary structure was discovered.

The peptide sequence was also searched for similarity to known domains and motifs using BLASTP with the Prosite, Blocks, Pfam, and ProDom databases. The searches produced no significant alignments to known domains. BLASTP comparison to the PRINTS database produced an alignment to the P450 protein family, but with a low probability of accuracy (e=6.9).

Two methods were used to predict secondary structure—the Garnier/Osguthorpe/Robson model and the Chou-Fasman model. The two methods differed somewhat in their results, but both produced representations of the peptide sequence with helical and sheet regions and locations of turns.

Antigenicity was plotted as a graph with amino acid number in the sequence on the x-axis and hydrophilicity on the y-axis. Several areas of antigenicity were observed, but only one with antigenicity greater than 2. Hydrophobicity was plotted in the same way. Only one region, from approximately residue 135 to residue 150, had notable hydrophobicity. TMpred, accessed through ExPASy, was used to predict transmembrane helices. No regions of the peptide sequence were predicted with reasonable confidence to be membrane-spanning helices.

NNPSL predicted that the putative protein would be found either in the nucleus (expected prediction accuracy=51.1%) or secreted from the cell (expected prediction accuracy=91.4%).

Example 7

Preparation of RNA from Mononuclear Cells for Expression Profiling

Blood was isolated from the subject for leukocyte expression profiling using the following methods:

Two tubes were drawn per patient. Blood was drawn from either a standard peripheral venous blood draw or directly from a large-bore intra-arterial or intravenous catheter inserted in the femoral artery, femoral vein, subclavian vein or internal jugular vein. Care was taken to avoid sample contamination with heparin from the intravascular catheters, as heparin can interfere with subsequent RNA reactions.

For each tube, 8 ml of whole blood was drawn into a tube (CPT, Becton-Dickinson order #362753) containing the anticoagulant Citrate, 25° C. density gradient solution (e.g. Ficoll, Percoll) and a polyester gel barrier that upon centrifugation was permeable to RBCs and granulocytes but not to mononuclear cells. The tube was inverted several times to mix the blood with the anticoagulant. The tubes were centrifuged at 1750×g in a swing-out rotor at room temperature for 20 minutes. The tubes were removed from the centrifuge and inverted 5-10 times to mix the plasma with the mononuclear cells, while trapping the RBCs and the granulocytes beneath the gel barrier. The plasma/mononuclear cell mix was decanted into a 15 ml tube and 5 ml of phosphate-buffered saline (PBS) is added. The 15 ml tubes were spun for 5 minutes at 1750×g to pellet the cells. The supernatant was discarded and 1.8 ml of RLT lysis buffer is added to the mononuclear cell pellet. The buffer and cells were pipetted up and down to ensure complete lysis of the pellet. The cell lysate was frozen and stored until it is convenient to proceed with isolation of total RNA.

Total RNA was purified from the lysed mononuclear cells using the Qiagen Rneasy Miniprep kit, as directed by the manufacturer (10/99 version) for total RNA isolation, including homogenization (Qiashredder columns) and on-column DNase treatment. The purified RNA was eluted in 50 ul of water.

Some samples were prepared by a different protocol, as follows:

Two 8 ml blood samples were drawn from a peripheral vein into a tube (CPT, Becton-Dickinson order #362753) containing anticoagulant (Citrate), 25° C. density gradient solution (Ficoll) and a polyester gel barrier that upon centrifugation is permeable to RBCs and granulocytes but not to mononuclear cells. The mononuclear cells and plasma remained above the barrier while the RBCs and granulocytes were trapped below. The tube was inverted several times to mix the blood with the anticoagulant, and the tubes were subjected to centrifugation at 1750×g in a swing-out rotor at room temperature for 20 min. The tubes were removed from the centrifuge, and the clear plasma layer above the cloudy mononuclear cell layer was aspirated and discarded. The cloudy mononuclear cell layer was aspirated, with care taken to rinse all of the mononuclear cells from the surface of the gel barrier with PBS (phosphate buffered saline). Approximately 2 mls of mononuclear cell suspension was transferred to a 2 ml microcentrifuge tube, and centrifuged for 3 min. at 16,000 rpm in a microcentrifuge to pellet the cells. The supernatant was discarded and 1.8 ml of RLT lysis buffer (Qiagen) were added to the mononuclear cell pellet, which lysed the cells and inactivated Rnases. The cells and lysis buffer were pipetted up and down to ensure complete lysis of the pellet. Cell lysate was frozen and stored until it was convenient to proceed with isolation of total RNA.

RNA samples were isolated from 8 mL of whole blood. Yields ranged from 2 ug to 20 ug total RNA for 8 mL blood. A260/A280 spectrophotometric ratios were between 1.6 and 2.0, indicating purity of sample. 2 ul of each sample were run on an agarose gel in the presence of ethidium bromide. No degradation of the RNA sample and no DNA contamination were visible.

In some cases, specific subsets of mononuclear cells were isolated from peripheral blood of human subjects. When this was done, the StemSep cell separation kits (manual version 6.0.0) were used from StemCell Technologies (Vancouver, Canada). This same protocol can be applied to the isolation of T cells, CD4 T cells, CD8 T cells, B cells, monocytes, NK cells and other cells. Isolation of cell types using negative selection with antibodies may be desirable to avoid activation of target cells by antibodies.

Example 8

Preparation of Universal Control RNA for Use in Leukocyte Expression Profiling

Control RNA was prepared using total RNA from Buffy coats and/or total RNA from enriched mononuclear cells isolated from Buffy coats, both with and without stimulation with ionomycin and PMA. The following control RNAs were prepared:
Control 1: Buffy Coat Total RNA
Control 2: Mononuclear cell Total RNA
Control 3: Stimulated buffy coat Total RNA
Control 4: Stimulated mononuclear Total RNA
Control 5: 50% Buffy coat Total RNA/50% Stimulated buffy coat Total RNA
Control 6: 50% Mononuclear cell Total RNA/50% Stimulated Mononuclear Total RNA.

Some samples were prepared using the following protocol: Buffy coats from 38 individuals were obtained from Stanford Blood Center. Each buffy coat is derived from ~350 mL whole blood from one individual. 10 ml buffy coat was removed from the bag, and placed into a 50 ml tube. 40 ml of Buffer EL (Qiagen) was added, the tube was mixed and placed on ice for 15 minutes, then cells were pelleted by centrifugation at 2000×g for 10 minutes at 4° C. The supernatant was decanted and the cell pellet was re-suspended in 10 ml of Qiagen Buffer EL. The tube was then centrifuged at 2000×g for 10 minutes at 4° C. The cell pellet was then re-suspended in 20 ml TRIZOL (GibcoBRL) per Buffy coat sample, the mixture was shredded using a rotary homogenizer, and the lysate was then frozen at −80° C. prior to proceeding to RNA isolation.

Other control RNAs were prepared from enriched mononuclear cells prepared from Buffy coats. Buffy coats from Stanford Blood Center were obtained, as described above. 10 ml buffy coat was added to a 50 ml polypropylene tube, and 10 ml of phosphate buffer saline (PBS) was added to each tube. A polysucrose (5.7 g/dL) and sodium diatrizoate (9.0 g/dL) solution at a 1.077+/−0.0001 g/ml density solution of equal volume to diluted sample was prepared (Histopaque 1077, Sigma cat. no 1077-1). This and all subsequent steps were performed at room temperature. 15 ml of diluted buffy coat/PBS was layered on top of 15 ml of the histopaque solution in a 50 ml tube. The tube was centrifuged at 400×g for 30 minutes at room temperature. After centrifugation, the upper layer of the solution to within 0.5 cm of the opaque interface containing the mononuclear cells was discarded. The opaque interface was transferred into a clean centrifuge tube. An equal volume of PBS was added to each tube and centrifuged at 350×g for 10 minutes at room temperature. The supernatant was discarded. 5 ml of Buffer EL (Qiagen) was used to resuspend the remaining cell pellet and the tube was centrifuged at 2000×g for 10 minutes at room temperature. The supernatant was discarded. The pellet was resuspended in 20 ml of TRIZOL (GibcoBRL) for each individual buffy coat that was processed. The sample was homogenized using a rotary homogenizer and frozen at −80 C until RNA was isolated.

RNA was isolated from frozen lysed Buffy coat samples as follows: frozen samples were thawed, and 4 ml of chloroform was added to each buffy coat sample. The sample was mixed by vortexing and centrifuged at 2000×g for 5 minutes. The aqueous layer was moved to new tube and then repurified by using the RNeasy Maxi RNA clean up kit, according to the manufacturer's instruction (Qiagen, PN 75162). The yield, purity and integrity were assessed by spectrophotometer and gel electrophoresis.

Some samples were prepared by a different protocol, as follows. The further use of RNA prepared using this protocol is described in Example 14.

50 whole blood samples were randomly selected from consented blood donors at the Stanford Medical School Blood Center. Each buffy coat sample was produced from ~350 mL of an individual's donated blood. The whole blood sample was centrifuged at ~4,400×g for 8 minutes at room temperature, resulting in three distinct layers: a top layer of plasma, a second layer of buffy coat, and a third layer of red blood cells. 25 ml of the buffy coat fraction was obtained and diluted with an equal volume of PBS (phosphate buffered saline). 30 ml of diluted buffy coat was layered onto 15 ml of sodium diatrizoate solution adjusted to a density of 1.077+/−0.001 g/ml (Histopaque 1077, Sigma) in a 50 mL plastic tube. The tube was spun at 800 g for 10 minutes at room temperature. The plasma layer was removed to the 30 ml mark on the tube, and the mononuclear cell layer removed into a new tube and washed with an equal volume of PBS, and collected by centrifugation at 2000 g for 10 minutes at room temperature. The cell pellet was resuspended in 10 ml of Buffer EL (Qiagen) by vortexing and incubated on ice for 10 minutes to remove any remaining erthythrocytes. The mononuclear cells were spun at 2000 g for 10 minutes at 4 degrees Celsius. The cell pellet was lysed in 25 ml of a phenol/guanidinium thiocyanate solution (TRIZOL Reagent, Invitrogen). The sample was homogenized using a PowerGene 5 rotary homogenizer (Fisher Scientific) and Omini disposable generator probes (Fisher Scientific). The Trizol lysate was frozen at −80 degrees C. until the next step.

The samples were thawed out and incubated at room temperature for 5 minutes. 5 ml chloroform was added to each sample, mixed by vortexing, and incubated at room temperature for 3 minutes. The aqueous layers were transferred to new 50 ml tubes. The aqueous layer containing total RNA was further purified using the Qiagen RNeasy Maxi kit (PN 75162), per the manufacturer's protocol (October 0.1999). The columns were eluted twice with 1 ml Rnase-free water, with a minute incubation before each spin. Quantity and quality of RNA was assessed using standard methods. Generally, RNA was isolated from batches of 10 buffy coats at a time, with an average yield per buffy coat of 870 µg, and an estimated total yield of 43.5 mg total RNA with a 260/280 ratio of 1.56 and a 28S/18S ratio of 1.78.

Quality of the RNA was tested using the Agilent 2100 Bioanalyzer using RNA 6000 microfluidics chips. Analysis of the electrophorgrams from the Bioanalyzer for five different batches demonstrated the reproducibility in quality between the batches.

Total RNA from all five batches were combined and mixed in a 50 ml tube, then aliquoted as follows: 2×10 ml aliquots in 15 ml tubes, and the rest in 100 µl aliquots in 1.5 ml microcentrifuge tubes. The aliquots gave highly reproducible results with respect to RNA purity, size and integrity. The RNA was stored at −80° C.

Test Hybridization of Reference RNA.

When compared with BC38 and Stimulated mononuclear reference samples, the R50 performed as well, if not better than the other reference samples as shown in FIG. 4.

In an analysis of hybridizations, where the R50 targets were fluorescently labeled with Cy-5 using methods described herein and the amplified and labeled aRNA was hybridized (as in example 14) to the olignoucleotide array described in example 13. The R50 detected 97.3% of probes with a Signal to Noise ratio (S/N) of greater than three and 99.9% of probes with S/N greater one.

Example 9

Identification of Diagnostic Oligonucleotides and Oligonucleotide Sets for Use in Monitoring Treatment and/or Progression of Rheumatoid Arthritis Rheumatoid arthritis (hereinafter, "RA") is a chronic and debilitating inflammatory arthritis. The diagnosis of RA is made by clinical criteria and radiographs. A new class of medication, TNF blockers, are effective, but the drugs are expensive, have side effects and not all patients respond to treatment. In addition, relief of disease symptoms does not always correlate with inhibition of joint destruction. For these reasons, an alternative mechanism for the titration of therapy is needed.

An observational study was conducted in which a cohort of patients meeting American College of Rheumatology (hereinafter "ARC") criteria for the diagnosis of RA was identified. Arnett et al. (1988) *Arthritis Rheum* 31:315-24. Patients gave informed consent and a peripheral blood mononuclear cell RNA sample was obtained by the methods as described herein. When available, RNA samples were also obtained from surgical specimens of bone or synovium from effected joints, and synovial fluid. Also, T-cells were isolated from the peripheral blood for some patients for expression analysis. This was done using the protocol given in Example 7.

From each patient, the following clinical information was obtained if available: Demographic information; information relating to the ACR criteria for RA; presence or absence of additional diagnoses of inflammatory and non-inflammatory conditions; data from laboratory test, including complete blood counts with differentials, CRP, ESR, ANA, Serum IL6, Soluble CD40 ligand, LDL, HDL, Anti-DNA antibodies, rheumatoid factor, C3, C4, serum creatinine and any medication levels; data from surgical procedures such as gross operative findings and pathological evaluation of resected tissues and biopsies; information on pharmacological therapy and treatment changes; clinical diagnoses of disease "flare"; hospitalizations; quantitative joint exams; results from health assessment questionnaires (HAQs); other clinical measures of patient symptoms and disability; physical examination results and radiographic data assessing joint involvement, synovial thickening, bone loss and erosion and joint space narrowing and deformity. In some cases, data includes pathological evaluation of synovial memebranes and joint tissues from RA and control patients. Pathology scoring systems were used to determine disease category, inflammation, type of inflammatory infiltrate, cellular and makeup of the synovial inflammation.

For some specimens of synovium, mononuclear cells or subsets of mononuclear cells (such as T cells) can be isolated for expression profiling. The relative number of lyphocyte subsets for some specimens can be determined by fluorescence activated cell sorting. Examples are determination of the CD4/CD8 T-cell ratio for a specimen. This information can be used as a variable to correlate to other outcomes or as an outcome for correlation analysis.

From these data, measures of improvement in RA are derived as exemplified by the ACR 20% and 50% response/improvement rates (Felson et al. 1996). Measures of disease activity over some period of time is derived from these data as are measures of disease progression. Serial radiography of effected joints is used for objective determination of progression (e.g., joint space narrowing, peri-articular osteoporosis, synovial thickening). Disease activity is determined from the clinical scores, medical history, physical exam, lab studies, surgical and pathological findings.

The collected clinical data (disease criteria) is used to define patient or sample groups for correlation of expression data. Patient groups are identified for comparison, for example, a patient group that possesses a useful or interesting clinical distinction, verses a patient group that does not possess the distinction. Examples of useful and interesting patient distinctions that can be made on the basis of collected clinical data are listed here:

Samples from patients during a clinically diagnosed RA flare versus samples from these same or different patients while they are asymptomatic.

Samples from patients who subsequently have high measures of disease activity versus samples from those same or different patients who have low subsequent disease activity.

Samples from patients who subsequently have high measures of disease progression versus samples from those same or different patients who have low subsequent disease progression.

Samples from patients who subsequently respond to a given medication or treatment regimen versus samples from those same or different patients who subsequently do not respond to a given medication or treatment regimen (for example, TNF pathway blocking medications).

Samples from patients with a diagnosis of osteoarthritis versus patients with rheumatoid arthritis.

Samples from patients with tissue biopsy results showing a high degree of inflammation versus samples from patients with lesser degrees of histological evidence of inflammation on biopsy.

Expression profiles correlating with progression of RA are identified. Subsets of the candidate library (or a previously identified diagnostic nucleotide set) are identified, according to the above procedures, that have predictive value for the progression of RA.

Diagnostic nucleotide set(s) are identified which predict respond to TNF blockade. Patients are profiled before and during treatment with these medications. Patients are followed for relief of symptoms, side effects and progression of joint destruction, e.g., as measured by hand radiographs. Expression profiles correlating with response to TNF blockade are identified. Subsets of the candidate library (or a previously identified diagnostic nucleotide set) are identified, according to the above procedures that have predictive value for response to TNF blockade.

Example 10

Identification of Diagnostic Oligonucleotide and Oligonucleotide Sets for Diagnosis of Systemic Lupus Erythematosis SLE is a chronic, systemic inflammatory disease characterized by dysregulation of the immune system. Clinical manifestations affect every organ system and include skin rash, renal dysfunction, CNS disorders, arthralgias and hematologic abnormalities. SLE clinical manifestations tend to both recur intermittently (or "flare") and progress over time, leading to permanent end-organ damage.

An observational study was conducted in which a cohort of patients meeting American College of Rheumatology (hereinafter "ACR") criteria for the diagnosis of SLE were identified. See Tan et al. (1982) *Arthritis Rheum* 25:1271-7. Patients gave informed consent and a peripheral blood mononuclear cell RNA sample or a peripheral T cell sample was obtained by the methods as described in example 7.

From each patient, the following clinical information was obtained if available: Demographic information, ACR criteria for SLE, additional diagnoses of inflammatory a n d noninflammatory conditions, data from laboratory testing including complete blood counts with differentials, CRP, ESR, ANA, Serum IL6, Soluble CD40 ligand, LDL, HDL, Anti-DNA antibodies, rheumatoid factor, C3, C4, serum creatinine (and other measures of renal dysfunction), medication levels, data from surgical procedures such as gross operative findings and pathological evaluation of resected tissues and biopsies (e.g., renal, CNS), information on pharmacological therapy and treatment changes, clinical diagnoses of disease "flare", hospitalizations, quantitative joint exams, results from health assessment questionnaires (HAQs), SLEDAIs (a clinical score for SLE activity that assess many clinical variables; Bombadier C, Gladman D D, Urowitz M B, Caron D, Chang C H and the Committee on Prognosis Studies in SLE: Derivation of the SLEDAI for Lupus Patients. *Arthritis Rheum* 35:630-640, 1992), other clinical measures of patient symptoms and disability, physical examination results and carotid ultrasonography.

The collected clinical data (disease criteria) is used to define patient or sample groups for correlation of expression data. Patient groups are identified for comparison, for example, a patient group that possesses a useful or interesting clinical distinction, verses a patient group that does not possess the distinction. Measures of disease activity in SLE are derived from the clinical data described above to divide patients (and patient samples) into groups with higher and lower disease activity over some period of time or at any one point in time. Such data are SLEDAI scores and other clinical scores, levels of inflammatory markers or complement, number of hospitalizations, medication use and changes, biopsy results and data measuring progression of end-organ damage or end-organ damage, including progressive renal failure, carotid atherosclerosis, and CNS dysfunction.

Expression profiles correlating with progression of SLE are identified, including expression profiles corresponding to end-organ damage and progression of end-organ damage. Expression profiles are identified predicting disease progression or disease "flare", response to treatment or likelihood of response to treatment, predict likelihood of "low" or "high" disease measures (optionally described using the SLEDAI score), and presence or likelihood of developing premature carotid atherosclerosis. Subsets of the candidate library (or a previously identified diagnostic nucleotide set) are identified, according to the above procedures that have predictive value for the progression of SLE.

Further examples of useful and interesting patient distinctions that can be made on the basis of collected clinical data are listed here. Samples can be grouped and groups are compared to discover diagnostic gene sets:

1. Samples from patients during a clinically diagnosed SLE flare versus samples from these same or different patients while they are asymptomatic or while they have a documented infection.

2. Samples from patients who subsequently have high measures of disease activity versus samples from those same or different patients who have low subsequent disease activity.

3. Samples from patients who subsequently have high measures of disease progression versus samples from those same or different patients who have low subsequent disease progression.

4. Samples from patients who subsequently respond to a given medication or treatment regimen versus samples from those same or different patients who subsequently do not respond to a given medication or treatment regimen.

5. Samples from patients with premature carotid atherosclerosis on ultrasonography versus patients with SLE without premature atherosclerosis.

Identification of a Diagnostic Oligonucleotide or Oligonucleotide Set for Diagnosis of Lupus Mononuclear RNA samples were collected from patients with SLE and patients with Rheumatoid or Osteoarthritis (RA and OA) or controls using the protocol described in example 7. The patient diagnoses were determined using standard diagnostic algorithms such as those that are employed by the American College of Rheumatology (see example See Tan et al. (1982) *Arthritis Rheum* 25:1271-7; Arnett et al. (1988) *Arthritis Rheum* 31:315-24).

32 samples were included in the anaysis. 15 samples were derived from patients with a clinical diagnosis of SLE and the remainder were derived from patients with RA (9), OA (4) and subjects without known disease (4) who served as controls. Samples from patients with SLE or RA were classified as "Active" or "Controlled" (with respect to disease activity) by the patient's physician based on objective and subjective criteria, such as patient history, physical exam and lab studies. An attempt was made to match SLE patients and controls with respect to important variables such as medication use, sex, age and secondary diagnoses.

After preparation of RNA (example 7), amplification, labeling, hybridization, scanning, feature extraction and data processing were done as described in Example 14 using the oligonucleotide microarrays described in Example 13. The resulting log ratio of expression of Cy3 (patient sample)/Cy5 (R50 reference RNA) was used for analysis.

Initially, significance analysis for microarrays (SAM, Tusher 2001, Example 16) was used to discover that were differentially expressed between 7 of the Lupus samples and 17 control samples. 1 gene was identified that was expressed at a higher level in the lupus patients than in all controls. This gene had a 0.5% false detection rate using SAM. This means that there is statistically, a 99.5% chance that the gene is truly differentially expressed between the Lupus and control samples. This gene was oligonucleotide and SEQ ID # 4637. The oligonucleotide:

GCCTCTTGCTTGGCGTGATAACCCTGT-
CATCTTCCCAAAGCTCATTTATG detects a specific human gene: sialyltransferase (SIAT4A), Unigene: Hs.301698 Locus: NM 003033, GI: 4506950. Expression ratios for the gene are given for each sample in FIG. 5A-B. The average fold change in expression between SLE and controls was 1.48.

When a larger data set was used, 15 SLE samples were compared to 17 controls. Using SAM, genes were identified as significantly differentially expressed between Lupus and controls. These genes and their FDRs are given in Table 10A. Supervised harvesting classification (X-Mine, Brisbane, Calif.) and CART (Salford Systems, San Diego Calif.) were also used on the same data to determine which set of genes best distinguish SLE from control samples (Example 16).

CART was used to build a decision tree for classification of samples as lupus or not lupus using the gene expression data from the arrays. The analysis identitifies sets of genes that can be used together to accurately identify samples derived from lupus patients. The set of genes and the identified threshold expression levels for the decision tree are referred to as "models". Multiple models for diagnosis of Lupus were derived by using different settings and parameters for the CART algorithm and using different sets of genes in the analysis. When using CART, it may be desirable to limit the number of independent variables. In the case of the genes on the arrays, a subset of ~8000 can be selected for analysis in CART based on significant differential expression discovered by using SAM or some other algorithm.

Model I was based on a data set consisting of thirty-two samples (fifteen SLE and seventeen non-SLE). These samples were used to derive the model and are referred to a the "training set'. Model I used the expression values for twenty-nine genes, which were found to be most significant in differentiating SLE and non-SLE samples in the analysis using SAM described above. SLE samples were designated as Class 1 and non-SLE samples were designated as Class 2. For this analysis, the following settings were used in the MODEL SETUP (CART, Salford Systems, San Diego, Calif.). In the Model settings, the tree type selected for the analysis was classification. In the Categorical settings, the default values were used. In the Testing settings, V-fold cross-validation was selected with a value of 10. In the Select Cases settings, the default values were used. In the Best Tree settings, the default values were used. In the Combine settings, the default values were used. In the Method settings, Symmetric Gini was selected as the type of classification tree and Linear combinations for splitting was also selected. The default values were used for the linear combinations. In the Advance Settings, the default values were used. In the Costs settings, the default values were used. In the Priors settings, Equal was selected as the priors for Class. In the penalty settings, the default values were used.

From this analysis, CART built two models, a two-gene model and a three-gene model (FIGS. 5C-E). The sensitivity and specificity for the identification of lupus in the training set samples of the two genes model were 100% and 94%, respectively. The sensitivity and specificity for the 10-fold cross validation set of the two-gene model were 100% and 88%, respectively, with a relative cost of 0.118. The sensitivity and specificity for the training set of the three genes model were 100% and 100%, respectively. The sensitivity and specificity for the 10-fold cross validation set of the three genes model were 93% and 94%, respectively, with a relative cost of 0.125.

Model II was based on a data set consisted of thirty-two samples, fifteen SLE and seventeen non-SLE (training set) and six thousand forty-four genes with expression values for at least 80% of the samples. The MODEL SETUP for the analysis of this data set was the same as for the analysis above, except for the following correction. In the Method settings, Linear combination for splitting was unchecked after the analysis yielded no classification tree. The change in the linear combination setting resulted in the following.

The sensitivity and specificity for the training set of the one gene model were 87% and 82%, respectively. The sensitivity and specificity for the 10-fold cross validation set of the one gene model were 80% and 59%, respectively, with a relative cost of 0.612. The sensitivity and specificity for the training set of the three genes model were 100% and 88%, respectively. The sensitivity and specificity for the 10-fold cross validation set of the three genes model were 67% and 65%, respectively, with a relative cost of 0.686. The sensitivity and specificity for the training set of the five genes model were 100% and 94%, respectively. The sensitivity and specificity for the 10-fold cross validation set of the five genes model were 67% and 59%, respectively, with a relative cost of 0.745. Results and models are summarized in FIGS. 5C and F.

Those genes that were found to be useful for classification are noted in Table 10A.

These genes can be used alone or in association with other genes or variables to build a diagnostic gene set or a classification algorithm. These genes can be used in association with known gene markers for lupus (such as those identified in the prior art) to provide a diagnostic algorithm.

Primers for real-time PCR validation were designed for each of the genes as described in Example 15 and are listed in Table 10B.

Surrogates for some of the most useful genes were identified and are listed in Table 10C. Surrogates can be used in addition to or in place of a diagnostic gene in a method of detecting lupus or in diagnostic gene set. For genes that were splitters in CART, surrogates were identified and reported by the software. In these cases, the best available surrogates are listed. For other genes, hierarchical clustering of the data was performed with default settings (x-miner, X-mine, Brisbane, Calif.) and members of gene expression clusters were noted.

A cluster was selected that included the gene of interest and the members of that cluster were recorded in Table 10C.

Example 11

Probe Selection for a 24,000 Feature Array

This Example describes the compilation of almost 8,000 unique genes and ESTs using sequences identified from the sources described below. The sequences of these genes and ESTs were used to design probes, as described in the following Example.

Tables 3A, 3B and 3C list the sequences identified in the subtracted leukocyte expression libraries. All sequences that were identified as corresponding to a known RNA transcript were represented at least once, and all unidentified sequences were represented twice—once by the sequence on file and again by the complementary sequence—to ensure that the sense (or coding) strand of the gene sequence was included.

Table 3A. Table 3A contained all those sequences in the subtracted libraries of example 1 that matched sequences in GenBank's nr, EST_Human, and UniGene databases with an acceptable level of confidence. All the entries in the table representing the sense strand of their genes were grouped together and all those representing the antisense strand were grouped. A third group contained those entries whose strand could not be determined. Two complementary probes were designed for each member of this third group.

Table 3B and 3C. Table 3B and 3C contained all those sequences in the leukocyte expression subtracted libraries of example 1 that did not match sequences in GenBank's nr, EST_Human, and UniGene databases with an acceptable level of confidence, but which had a high probability of representing real mRNA sequences. Sequences in Table 3B did not match anything in the databases above but matched regions of the human genome draft and were spatially clustered along it, suggesting that they were exons, rather than genomic DNA included in the library by chance. Sequences in Table 3C also aligned well to regions of the human genome draft, but the aligned regions were interrupted by genomic DNA, meaning they were likely to be spliced transcripts of multiple exon genes.

Table 3B lists 510 clones and Table 3C lists 48 clones that originally had no similarity with any sequence in the public databases. Blastn searches conducted after the initial filing have identified sequences in the public database with high similarity (E values less than 1 e-40) to the sequences determined for these clones. Table 3B contained 272 clones and Table 3C contained 25 clones that were found to have high similarity to sequences in dbEST. The sequences of the similar dbEST clones were used to design probes. Sequences from clones that contained no similar regions to any sequence in the database were used to design a pair of complementary probes.

Probes were designed from database sequences that had the highest similarity to each of the sequenced clones in Tables 3A, 3B, and 3C. Based on BLASTn searches the most similar database sequence was identified by locus number and the locus number was submitted to GenBank using batch Entrez (located at the website ncbi.nlm.nih.gov/entrez/batchentrez.cgi?db=Nucleotide) to obtain the sequence for that locus. The GenBank entry sequence was used because in most cases it was more complete or was derived from multi-pass sequencing and thus would likely have fewer errors than the single pass cDNA library sequences. When only UniGene cluster IDs were available for genes of interest, the respective sequences were extracted from the UniGene_unique database, build 137, downloaded from NCBI (ftp://ncbi.nlm.nih.gov/repository/UniGene/). This database contains one representative sequence for each cluster in UniGene.

Summary of library clones used in array probe design

| Table | Sense Strand | Antisnese Strand | Strand Undetermined |
|-------|--------------|------------------|---------------------|
| 3A    | 3621         | 763              | 124                 |
| 3B    | 142          | 130              | 238                 |
| 3C    | 19           | 6                | 23                  |
| Totals| 3782         | 899              | 385                 |

Literature Searches

Example 2 describes searches of literature databases. We also searched for research articles discussing genes expressed only in leukocytes or involved in inflammation and particular disease conditions, including genes that were specifically expressed or down-regulated in a disease state. Searches included, but were not limited to, the following terms and various combinations of theses terms: inflammation, atherosclerosis, rheumatoid arthritis, osteoarthritis, lupus, SLE, allograft, transplant, rejection, leukocyte, monocyte, lymphocyte, mononuclear, macrophage, neutrophil, eosinophil, basophil, platelet, congestive heart failure, expression, profiling, microarray, inflammatory bowel disease, asthma, RNA expression, gene expression, granulocyte.

A-UniGene cluster ID or GenBank accession number was found for each gene in the list: The strand of the corresponding sequence was determined, if possible, and the genes were divided into the three groups: sense (coding) strand, antisense strand, or strand unknown. The rest of the probe design process was carried out as described above for the sequences from the leukocyte subtracted expression library.

Database Mining

Database mining was performed as described in Example 2. In addition, the Library Browser at the NCBI UniGene web site (located on the web at ncbi.nlm.nih.gov/UniGene/lbrowse.cgi?ORG=Hs&DISPLAY=ALL) was used to identify genes that are specifically expressed in leukocyte cell populations. All expression libraries available at the time were examined and those derived from leukocytes were viewed individually. Each library viewed through the Library Browser at the UniGene web site contains a section titled "Shown below are UniGene clusters of special interest only" that lists genes that are either highly represented or found only in that library. Only the genes in this section were downloaded from each library. Alternatively, every sequence in each library is downloaded and then redundancy between libraries is reduced by discarding all UniGene cluster IDs that are represented more than once. A total of 439 libraries were downloaded, containing 35,819 genes, although many were found in more than one library. The most important libraries from the remaining set were separated and 3,914 genes remained. After eliminating all redundancy between these libraries and comparing the remaining genes to those listed in Tables 3A, 3B and 3C, the set was reduced to 2,573 genes in 35 libraries as shown in Table 4. From these, all genes in first 30 libraries were used to design probes. A random subset of genes was used from Library Lib.376, "Activated_T-cells_XX". From the last four libraries, a random subset of sequences listed as "ESTs, found only in this library" was used.

Angiogenesis Markers 215 sequences derived from an angiogenic endothelial cell subtracted cDNA library obtained from Stanford University were used for probe design. Briefly, using well known subtractive hybridization procedures, (as described in, e.g., U.S. Pat. Nos. 5,958,738; 5,589,339; 5,827,658; 5,712,127; 5,643,761; 5,565,340) modified to normalize expression by suppressing over-representation of abundant RNA species while increasing representation of rare RNA species, a library was produced that is enriched for RNA species (messages) that are differentially expressed between test (stimulated) and control (resting) HUVEC populations. The subtraction/suppression protocol was performed as described by the kit manufacturer (Clontech, PCR-select cDNA Subtraction Kit).

Pooled primary HUVECs (Clonetics) were cultured in 15% FCS, M199 (GibcoBRL) with standard concentrations of Heparin, Penicillin, Streptomycin, Glutamine and Endothelial Cell Growth Supplement. The cells were cultured on 1% gelatin coated 10 cm dishes. Confluent HUVECs were photographed under phase contrast microscopy. The cells formed a monolayer of flat cells without gaps. Passage 2-5 cells were used for all experiments. Confluent HUVECs were treated with trypsin/EDTA and seeded onto collagen gels. Collagen gels were made according to the protocol of the Collagen manufacturer (Becton Dickinson Labware). Collagen gels were prepared with the following ingredients: Rat tail collagen type I (Collaborative Biomedical) 1.5 mg/mL, mouse laminin (Collaborative Biomedical) 0.5 mg/mL, 10% 10× media 199 (Gibco BRL). 1N NaOH, 10×PBS and sterile water were added in amounts recommended in the protocol. Cell density was measured by microscopy. $1.2 \times 10^6$ cells were seeded onto gels in 6-well, 35 mm dishes, in 5% FCS M199 media. The cells were incubated for 2 hrs at 37 C with 5% CO2. The media was then changed to the same media with the addition of VEGF (Sigma) at 30 ng/mL media. Cells were cultured for 36 hrs. At 12, 24 and 36 hrs, the cells were observed with phase contrast microscopy. At 36 hours, the cells were observed elongating, adhering to each other and forming lumen structures. At 12 and 24 hrs media was aspirated and refreshed. At 36 hrs, the media was aspirated, the cells were rinsed with PBS and then treated with Collagenase (Sigma) 2.5 mg/mL PBS for 5 min with active agitation until the collagen gels were liquefied. The cells were then centrifuged at 4C, 2000 g for 10 min. The supernatant was removed and the cells were lysed with 1 mL Trizol Reagent (Gibco) per $5 \times 10^6$ cells. Total RNA was prepared as specified in the Trizol instructions for use. mRNA was then isolated as described in the micro-fast track mRNA isolation protocol from Invitrogen. This RNA was used as the tester RNA for the subtraction procedure.

Ten plates of resting, confluent, p4 HUVECs, were cultured with 15% FCS in the M199 media described above. The media was aspirated and the cells were lysed with 1 mL Trizol and total RNA was prepared according to the Trizol protocol. mRNA was then isolated according to the micro-fast track mRNA isolation protocol from Invitrogen. This RNA served as the control RNA for the subtraction procedure.

The entire subtraction cloning procedure was carried out as per the user manual for the Clontech PCR Select Subtraction Kit. The cDNAs prepared from the test population of HUVECs were divided into "tester" pools, while cDNAs prepared from the control population of HUVECs were designated the "driver" pool. cDNA was synthesized from the tester and control RNA samples described above. Resulting cDNAs were digested with the restriction enzyme RsaI. Unique double-stranded adapters were ligated to the tester cDNA. An initial hybridization was performed consisting of the tester pools of cDNA (with its corresponding adapter) and an excess of the driver cDNA. The initial hybridization results in a partial normalization of the cDNAs such that high and low abundance messages become more equally represented following hybridization due to a failure of driver/tester hybrids to amplify.

A second hybridization involved pooling unhybridized sequences from the first hybridization together with the addition of supplemental driver cDNA. In this step, the expressed sequences enriched in the two tester pools following the initial hybridization can hybridize. Hybrids resulting from the hybridization between members of each of the two tester pools are then recovered by amplification in a polymerase chain reaction (PCR) using primers specific for the unique adapters. Again, sequences originating in a tester pool that form hybrids with components of the driver pool are not amplified. Hybrids resulting between members of the same tester pool are eliminated by the formation of "panhandles" between their common 5' and 3' ends. The subtraction was done in both directions, producing two libraries, one with clones that are upregulated in tube-formation and one with clones that are down-regulated in the process.

The resulting PCR products representing partial cDNAs of differentially expressed genes were then cloned (i.e., ligated) into an appropriate vector according to the manufacturer's protocol (pGEM-Teasy from Promega) and transformed into competent bacteria for selection and screening. Colonies (2180) were picked and cultured in LB broth with 50 ug/mL ampicillin at 37 C overnight. Stocks of saturated LB +50 ug/mL ampicillin and 15% glycerol in 96-well plates were stored at −80 C. Plasmid was prepared from 1.4 mL saturated LB broth containing 50 ug/mL ampicillin. This was done in a 96 well format using commercially available kits according to the manufacturer's recommendations (Qiagen 96-turbo prep).

2 probes to represent 22 of these sequences required, therefore, a total of 237 probes were derived from this library.

Viral Genes

Several viruses may play a role in a host of disease including inflammatory disorders, atherosclerosis, and transplant rejection. Table 12 lists the viral genes represented by oligonucleotide probes on the microarray. Low-complexity regions in the sequences were masked using RepeatMasker before using them to design probes.

Strand Selection

It was necessary to design sense oligonucleotide probes because the labeling and hybridization protocol to be used with the microarray results in fluorescently-labeled antisense cRNA. All of the sequences we selected to design probes could be divided into three categories:

(1) Sequences known to represent the sense strand
(2) Sequences known to represent the antisense strand
(3) Sequences whose strand could not be easily determined from their descriptions It was not known whether the sequences from the leukocyte subtracted expression library were from the sense or antisense strand. GenBank sequences are reported with sequence given 5' to 3', and the majority of the sequences we used to design probes came from accession numbers with descriptions that made it clear whether they represented sense or antisense sequence. For example, all sequences containing "mRNA" in their descriptions were understood to be the sequences of the sense mRNA, unless otherwise noted in the description, and all IMAGE Consortium clones are directionally cloned and so the direction (or sense) of the reported sequence can be determined from the annotation in the GenBank record.

For accession numbers representing the sense strand, the sequence was downloaded and masked and a probe was designed directly from the sequence. These probes were selected as close to the 3' end as possible. For accession numbers representing the antisense strand, the sequence was downloaded and masked, and a probe was designed complementary to this sequence. These probes were designed as close to the 5' end as possible (i.e., complementary to the 3' end of the sense strand).

Minimizing Probe Redundancy

Multiple copies of certain genes or segments of genes were included in the sequences from each category described above, either by accident or by design. Reducing redundancy within each of the gene sets was necessary to maximize the number of unique genes and ESTs that could be represented on the microarray.

Three methods were used to reduce redundancy of genes, depending on what information was available. First, in gene sets with multiple occurrences of one or more UniGene numbers, only one occurrence of each UniGene number was kept. Next, each gene set was searched by GenBank accession numbers and only one occurrence of each accession number was conserved. Finally, the gene name, description, or gene symbol were searched for redundant genes with no UniGene number or different accession numbers. In reducing the redundancy of the gene sets, every effort was made to conserve the most information about each gene.

We note, however, that the UniGene system for clustering submissions to GenBank is frequently updated and UniGene cluster IDs can change. Two or more clusters may be combined under a new cluster ID or a cluster may be split into several new clusters and the original cluster ID retired. Since the lists of genes in each of the gene sets discussed were assembled at different times, the same sequence may appear in several different sets with a different UniGene ID in each.

Sequences from Table 3A were treated differently. In some cases, two or more of the leukocyte subtracted expression library sequences aligned to different regions of the same GenBank entry, indicating that these sequences were likely to be from different exons in the same gene transcript. In these cases, one representative library sequence corresponding to each presumptive exon was individually listed in Table 3A.

Compilation

After redundancy within a gene set was sufficiently reduced, a table of approximately 8,000 unique genes and ESTs was compiled in the following manner. All of the entries in Table 3A were transferred to the new table. The list of genes produced by literature and database searches was added, eliminating any genes already contained in Table 3A. Next, each of the remaining sets of genes was compared to the table and any genes already contained in the table were deleted from the gene sets before appending them to the table.

| | Probes |
|---|---|
| Subtracted Leukocyte Expression Library | |
| Table 3A | 4,872 |
| Table 3B | 796 |
| Table 3C | 85 |
| Literature Search Results | 494 |
| Database Mining | 1,607 |
| Viral genes | |
| a. CMV | 14 |
| b. EBV | 6 |
| c. HHV6 | 14 |
| d. Adenovirus | 8 |
| Angiogenesis markers: 215, 22 of which needed two probes | 237 |
| *Arabidopsis thaliana* genes | 10 |
| Total sequences used to design probes | 8,143 |

Example 12

Design of Oligonucleotide Probes

By way of example, this section describes the design of four oligonucleotide probes using Array Designer Ver 1.1 (Premier Biosoft International, Palo Alto, Calif.). The major steps in the process are given first.

1) Obtain best possible sequence of mRNA from GenBank. If a full-length sequence reference sequence is not available, a partial sequence is used, with preference for the 3' end over the 5' end. When the sequence is known to represent the antisense strand, the reverse complement of the sequence is used for probe design. For sequences represented in the subtracted leukocyte expression library that have no significant match in GenBank at the time of probe design, our sequence is used.

2) Mask low complexity regions and repetitive elements in the sequence using an algorithm such as RepeatMasker.

3) Use probe design software, such as Array Designer, version 1.1, to select a sequence of 50 residues with specified physical and chemical properties. The 50 residues nearest the 3' end constitute a search frame. The residues it contains are tested for suitability. If they don't meet the specified criteria, the search frame is moved one residue closer to the 5' end, and the 50 residues it now contains are tested. The process is repeated until a suitable 50-mer is found.

4) If no such 50-mer occurs in the sequence, the physical and chemical criteria are adjusted until a suitable 50-mer is found.

5) Compare the probe to dbEST, the UniGene cluster set, and the assembled human genome using the BLASTn search tool at NCBI to obtain the pertinent identifying information and to verify that the probe does not have significant similarity to more than one known gene.

Clone 40H12

Clone 40H12 was sequenced and compared to the nr, dbEST, and UniGene databases at NCBI using the BLAST search tool. The sequence matched accession number NM_002310, a 'curated RefSeq project' sequence, see Pruitt et al. (2000) *Trends Genet.* 16:44-47, encoding leukemia inhibitory factor receptor (LIFR) mRNA with a reported E value of zero. An E value of zero indicates there is, for all practical purposes, no chance that the similarity was random based on the length of the sequence and the composition and size of the database. This sequence, cataloged by accession number NM_002310, is much longer than the sequence of clone 40H12 and has a poly-A tail. This indicated that the sequence cataloged by accession number NM_002310 is the sense strand and a more complete representation of the mRNA than the sequence of clone 40H12, especially at the 3' end. Accession number "NM_002310" was included in a text file of accession numbers representing sense strand mRNAs, and sequences for the sense strand mRNAs were obtained by uploading a text file containing desired accession numbers as an Entrez search query using the Batch Entrez web interface and saving the results locally as a FASTA file. The following sequence was obtained, and the region of alignment of clone 40H12 is outlined:

```
CTCTCTCCCAGAACGTGTCTCTGCTGCAAGGCACCGGGCCCTTTCGCTCTGCAGAACTGC    (SEQ ID NO: 8827)
ACTTGCAAGACCATTATCAACTCCTAATCCCAGCTCAGAAAGGGAGCCTCTGCGACTCAT
TCATCGCCCTCCAGGACTGACTGCATTGCACAGATGATGGATATTTACGTATGTTTGAAA
CGACCATCCTGGATGGTGGACAATAAAAGAATGAGGACTGCTTCAAATTTCCAGTGGCTG
TTATCAACATTTATTCTTCTATATCTAATGAATCAAGTAAATAGCCAGAAAAAGGGGGCT
CCTCATGATTTGAAGTGTGTAACTAACAATTTGCAAGTGTGGAACTGTTCTTGGAAAGCA
CCCTCTGGAACAGGCCGTGGTACTGATTATGAAGTTTGCATTGAAAACAGGTCCCGTTCT
TGTTATCAGTTGGAGAAAACCAGTATTAAAATTCCAGCTCTTTCACATGGTGATTATGAA
ATAACAATAAATTCTCTACATGATTTTGGAAGTTCTACAAGTAAATTCACACTAAATGAA
CAAAACGTTTCCTTAATTCCAGATACTCCAGAGATCTTGAATTTGTCTGCTGATTTCTCA
ACCTCTACATTATACCTAAAGTGGAACGACAGGGGTTCAGTTTTTCCACACCGCTCAAAT
GTTATCTGGGAAATTAAAGTTCTACGTAAAGAGAGTATGGAGCTCGTAAAATTAGTGACC
CACAACACAACTCTGAATGGCAAAGATACACTTCATCACTGGAGTTGGGCCTCAGATATG
CCCTTGGAATGTGCCATTCATTTTGTGGAAATTAGATGCTACATTGACAATCTTCATTTT
TCTGGTCTCGAAGAGTGGAGTGACTGGAGCCCTGTGAAGAACATTTCTTGGATACCTGAT
TCTCAGACTAAGGTTTTTCCTCAAGATAAAGTGATACTTGTAGGCTCAGACATAACATTT
TGTTGTGTGAGTCAAGAAAAAGTGTTATCAGCACTGATTGGCCATACAAACTGCCCCTTG
ATCCATCTTGATGGGGAAAATGTTGCAATCAAGATTCGTAATATTTCTGTTTCTGCAAGT
AGTGGAACAAATGTAGTTTTTACAACCGAAGATAACATATTTGGAACCGTTATTTTTGCT
GGATATCCACCAGATACTCCTCAACAACTGAATTGTGAGACACATGATTTAAAAGAAATT
ATATGTAGTTGGAATCCAGGAAGGGTGACAGCGTTGGTGGGCCCACGTGCTACAAGCTAC
ACTTTAGTTGAAAGTTTTTCAGGAAAATATGTTAGACTTAAAAGAGCTGAAGCACCTACA
AACGAAAGCTATCAATTATTATTTCAAATGCTTCCAAATCAAGAAATATATAATTTTACT
TTGAATGCTCACAATCCGCTGGGTCGATCACAATCAACAATTTTAGTTAATATAACTGAA
AAAGTTTATCCCCATACTCCTACTTCATTCAAAGTGAAGGATATTAATTCAACAGCTGTT
AAACTTTCTTGGCATTTACCAGGCAACTTTGCAAAGATTAATTTTTTATGTGAAATTGAA
ATTAAGAAATCTAATTCAGTACAAGAGCAGCGGAATGTCACAATCAAAGGAGTAGAAAAT
TCAAGTTATCTTGTTGCTCTGGACAAGTTAAATCCATACACTCTATATACTTTTCGGATT
CGTTGTTCTACTGAAACTTTCTGGAAATGGAGCAAATGGAGCAATAAAAAACAACATTTA
ACAACAGAAGCCAGTCCTTCAAAGGGGCCTGATACTTGGAGAGAGTGGAGTTCTGATGGA
AAAAATTTAATAATCTATTGGAAGCCTTTACCCATTAATGAAGCTAATGGAAAAATACTT
TCCTACAATGTATCGTGTTCATCAGATGAGGAAACACAGTCCCTTTCTGAAATCCCTGAT
CCTCAGCACAAAGCAGAGATACGACTTGATAAGAATGACTACATCATCAGCGTAGTGGCT
AAAAATTCTGTGGGCTCATCACCACCTTCCAAAATAGCGAGTATGGAAATTCCAAATGAT
GATCTCAAAATAGAACAAGTTGTTGGGATGGGAAAGGGGATTCTCCTCACCTGGCATTAC
GACCCCAACATGACTTGCGACTACGTCATTAAGTGGTGTAACTCGTCTCGGTCGGAACCA
TGCCTTATGGACTGGAGAAAAGTTCCCTCAAACAGCACTGAAACTGTAATAGAATCTGAT
GAGTTTCGACCAGGTATAAGATATAATTTTTTCCTGTATGGATGCAGAAATCAAGGATAT
CAATTATTACGCTCCATGATTGGATATATAGAAGAATTGGCTCCCATTGTTGCACCAAAT
TTTACTGTTGAGGATACTTCTGCAGATTCGATATTAGTAAAATGGGAAGACATTCCTGTG
GAAGAACTTAGAGGCTTTTTAAGAGGATATTTGTTTTACTTTGGAAAAGGAGAAAGAGAC
ACATCTAAGATGAGGGTTTTAGAATCAGGTCGTTCTGACATAAAAGTTAAGAATATTACT
```

-continued

```
GACATATCCCAGAAGACACTGAGAATTGCTGATCTTCAAGGTAAAACAAGTTACCACCTG
GTCTTGCGAGCCTATACAGATGGTGGAGTGGGCCCGGAGAAGAGTATGTATGTGGTGACA
AAGGAAAATTCTGTGGGATTAATTATTGCCATTCTCATCCCAGTGGCAGTGGCTGTCATT
GTTGGAGTGGTGACAAGTATCCTTTGCTATCGGAAACGAGAATGGATTAAAGAAACCTTC
TACCCTGATATTCCAAATCCAGAAAACTGTAAAGCATTACAGTTTCAAAAGAGTGTCTGT
GAGGGAAGCAGTGCTCTTAAAACATTGGAAATGAATCCTTGTACCCCAAATAATGTTGAG
GTTCTGGAAACTCGATCAGCATTTCCTAAAATAGAAGATACAGAAATAATTTCCCCAGTA
GCTGAGCGTCCTGAAGATCGCTCTGATGCAGAGCCTGAAAACCATGTGGTTGTGTCCTAT
TGTCCACCCATCATTGAGGAAGAAATACCAAACCCAGCCGCAGATGAAGCTGGAGGGACT
GCACAGGTTATTTACATTGATGTTCAGTCGATGTATCAGCCTCAAGCAAAACCAGAAGAA
GAACAAGAAAATGACCCTGTAGGAGGGGCAGGCTATAAGCCACAGATGCACCTCCCCATT
AATTCTACTGTGGAAGATATAGCTGCAGAAGAGGACTTAGATAAAACTGCGGGTTACAGA
CCTCAGGCCAATGTAAATACATGGAATTTAGTGTCTCCAGACTCTCCTAGATCCATAGAC
AGCAACAGTGAGATTGTCTCATTTGGAAGTCCATGCTCCATTAATTCCCGACAATTTTTG
ATTCCTCCTAAAGATGAAGACTCTCCTAAATCTAATGGAGGAGGGTGGTCCTTTACAAAC
TTTTTTCAGAACAAACCAAACGATTAACAGTGTCACCGTGTCACTTCAGTCAGCCATCTC
AATAAGCTCTTACTGCTAGTGTTGCTACATCAGCACTGGGCATTCTTGGAGGGATCCTGT
GAAGTATTGTTAGGAGGTGAACTTCACTACATGTTAAGTTACACTGAAAGTTCATGTGCT
TTTAATGTAGTCTAAAAGCCAAAGTATAGTGACTCAGAATCCTCAATCCACAAAACTCAA
GATTGGGAGCTCTTTGTGATCAAGCCAAAGAATTCTCATGTACTCTACCTTCAAGAAGCA
TTTCAAGGCTAATACCTACTTGTACGTACATGTAAAACAAATCCCGCCGCAACTGTTTTC

TGTTCTGTTGTTTGTGGTTTTCTCATATGTATACTTGGTGGAATTGTAAGTGGATTTGCA
GGCCAGGGAGAAAATGTCCAAGTAACAGGTGAAGTTTATTTGCCTGACGTTTACTCCTTT
CTAGATGAAAACCAAGCACAGATTTTAAAACTTCTAAGATTATTCTCCTCTATCCACAGC
ATTCACAAAAATTAATATAATTTTTAATGTAGTGACAGCGATTTAGTGTTTTGTTTGATA
AAGTATGCTTATTTCTGTGCCTACTGTATAATGGTTATCAAACAGTTGTCTCAGGGGTAC
AAACTTTGAAAACAAGTGTGACACTGACCAGCCCAAAT[CATAATCATGTTTTCTTGCTGT
GATAGGTTTTGCTTGCCTTTTCATTATTTTTTAGCTTTTATGCTTGCTTCCATTATTTCA]
[GTTGGTTGCCCTAATATTTAAAATTTACACTTCTAAGACTAGAGACCCACATTTTTTAAA]
[AATCATTTTATTTTGTGATACAGTGACAGCTTTATATGAGCAAATTCAATATTATTCATA]
[AGCATGTAATTCCAGTGACTTACTATGTGAGATGACTACTAAGCAATATCTAGCAGCGTT]
[AGTTCCATATAGTTCTGATTGGATTTCGTTCCTCCTGAGGAGACCATGCCGTTGAGCTTG]
[GCTACCCAGGCAGTGGTGATCTTTGACACCTTCTGGTGGATGTTCCTCCCACTCATGAGT]
[CTTTTCATCATGCCACATTATCTGATCCAGTCCTCACATTTTTAAATATAAAACTAAAGA]
[GAGAATGCTTCTTACAGGAACAGTTACCCAAGGGCTGTTTCTTAGTAACTGTCATAAACT]
[GATCTGGATCCATGGGCATACCTGTGTTCGAGGTGCAGCAATTGCTTGGTGAGCTGTGCA]
[GAATTGATTGCCTTCAGCACAGCATCCTCTGCCCACCCTTGTTTCTCATAAGCGATGTCT]
[GGAGTGATTGTGGTTCTTGGAAAAGCAGAAGGAAAAACTAAAAAGTGTATCTTGTATTTT]
[CCCTGCC]CTCAGGTTGCCTATGTATTTTACCTTTTCATATTTAAGGCAAAAGTACTTGAA
AATTTTAAGTGTCCGAATAAGATATGTCTTTTTTGTTTGTTTTTTTTGGTTGGTTGTTTG
TTTTTTATCATCTGAGATTCTGTAATGTATTTGCAAATAATGGATCAATTAATTTTTTTT
GAAGCTCATATTGTATCTTTTTAAAAACCATGTTGTGGAAAAAAGCCAGAGTGACAAGTG

ACAAAATCTATTTAGGAACTCTGTGTATGAATCCTGATTTTAACTGCTAGGATTCAGCTA
AATTTCTGAGCTTTATGATCTGTGGAAATTTGGAATGAAATCGAATTCATTTTGTACATA
CATAGTATATTAAAACTATATAATAGTTCATAGAAATGTTCAGTAATGAAAAAATATATC
CAATCAGAGCCATCCCGAAAAAAAAAAAAAAAA
```

The FASTA file, including the sequence of NM_002310, was masked using the RepeatMasker web interface (Smit, AFA & Green, P RepeatMasker at genome.washington.edu/ RM/RepeatMasker.html, Smit and Green). Specifically, during masking, the following types of sequences were replaced with "N's": SINE/MIR & LINE/L2, LINE/L1, LTR/MaLR, LTR/Retroviral, Alu, and other low informational content sequences such as simple repeats. Below is the sequence following masking:

| | (SEQ ID NO: 8828) |
|---|---|
| CTCTCTCCCAGAACGTGTCTCTGCTGCAAGGCACCGGGCCCTTTCGCTCTGCAGAACTG | |
| CACTTGCAAGACCATTATCAACTCCTAATCCCAGCTCAGAAAGGGAGCCTCTGCGACTC | |
| ATTCATCGCCCTCCAGGACTGACTGCATTGCACAGATGATGGATATTTACGTATGTTTG | |
| AAACGACCATCCTGGATGGTGGACAATAAAAGAATGAGGACTGCTTCAAATTTCCAGTG | |
| GCTGTTATCAACATTTATTCTTCTATATCTAATGAATCAAGTAAATAGCCAGAAAAAGG | |
| GGGCTCCTCATGATTTGAAGTGTGTAACTAACAATTTGCAAGTGTGGAACTGTTCTTGG | |
| AAAGCACCCTCTGGAACAGGCCGTGGTACTGATTATGAAGTTTGCATTGAAAACAGGTC | |
| CCGTTCTTGTTATCAGTGGGAGAAAACCAGTATTAAAATTCCAGCTCTTTCACATGGTG | |
| ATTATGAAATAACAATAAATTCTCTACATGATTTTGGAAGTTCTACAAGTAAATTCACA | |
| CTAAATGAACAAAACGTTTCCTTAATTCCAGATACTCCAGAGATCTTGAATTTGTCTGC | |
| TGATTTCTCAACCTCTACATTATACCTAAAGTGGAACGACAGGGGTTCAGTTTTTCCAC | |
| ACCGCTCAAATGTTATCTGGGAAATTAAAGTTCTACGTAAAGAGTATGGAGCTCGTA | |
| AAATTAGTGACCCACAACACAACTCTGAATGGCAAAGATACACTTCATCACTGGAGTTG | |
| GGCCTCAGATATGCCCTTGGAATGTGCCATTCATTTTGTGGAAATTAGATGCTACATTG | |
| ACAATCTTCATTTTCTGGTCTCGAAGAGTGGAGTGACTGGAGCCCTGTGAAGAACATT | |
| TCTTGGATACCTGATTCTCAGACTAAGGTTTTTCCTCAAGATAAAGTGATACTTGTAGG | |
| CTCAGACATAACATTTTGTTGTGTGAGTCAAGAAAAAGTGTTATCAGCACTGATTGGCC | |
| ATACAAACTGCCCCTTGATCCATCTTGATGGGGAAAATGTTGCAATCAAGATTCGTAAT | |
| ATTTCTGTTTCTGCAAGTAGTGGAACAAATGTAGTTTTTACAACCGAAGATAACATATT | |
| TGGAACCGTTATTTTTGCTGGATATCCACCAGATACTCCTCAACAACTGAATTGTGAGA | |
| CACATGATTTAAAAGAAATTATATGTAGTTGGAATCCAGGAAGGGTGACAGCGTTGGTG | |

| |
|---|
| GGCCCACGTGCTACAAGCTACACTTTAGTTGAAAGTTTTTCAGGAAAATATGTTAGACT |
| TAAAAGAGCTGAAGCACCTACAAACGAAAGCTATCAATTATTATTTCAAATGCTTCCAA |
| ATCAAGAAATATATAATTTTACTTTGAATGCTCACAATCCGCTGGGTCGATCACAATCA |
| ACAATTTTAGTTAATATAACTGAAAAAGTTTATCCCCATACTCCTACTTCATTCAAAGT |
| GAAGGATATTAATTCAACAGCTGTTAAACTTTCTTGGCATTTACCAGGCAACTTTGCAA |
| AGATTAATTTTTTATGTGAAATTGAAATTAAGAAATCTAATTCAGTACAAGAGCAGCGG |
| AATGTCACAATCAAAGGAGTAGAAAATTCAAGTTATCTTGTTGCTCTGGACAAGTTAAA |
| TCCATACACTCTATATACTTTTCGGATTCGTTGTTCTACTGAAACTTTCTGGAAATGGA |
| GCAAATGGAGCAATAAAAAACAACATTTAACAACAGAAGCCAGTCCTTCAAAGGGGCCT |
| GATACTTGGAGAGAGTGGAGTTCTGATGGAAAAAATTTAATAATCTATTGGAAGCCTTT |
| ACCCATTAATGAAGCTAATGGAAAAATACTTTCCTACAATGTATCGTGTTCATCAGATG |
| AGGAAACACAGTCCCTTTCTGAAATCCCTGATCCTCAGCACAAAGCAGAGATACGACTT |
| CATAAGAATGACTACATCATCAGCGTAGTGGCTAAAAATTCTGTGGGCTCATCACCACC |
| TTCCAAATAGCGAGTATGGAAATTCCAAATGATGATCTCAAAATAGAACAAGTTGTTG |
| GGATGGGAAAGGGGATTCTCCTCACCTGGCATTACGACCCCAACATGACTTGCGACTAC |
| GTCATTAAGTGGTGTAACTCGTCTCGGTCGGAACCATGCCTTATGGACTGGAGAAAAGT |
| TCCCTCAAACAGCACTGAAACTGTAATAGAATCTGATGAGTTTCGACCAGGTATAAGAT |
| ATAATTTTTTCCTGTATGGATGCAGAAATCAAGGATATCAATTATTACGCTCCATGATT |
| GGATATATAGAAGAATTGGCTCCCATTGTTGCACCAAATTTTACTGTTGAGGATACTTC |
| TGCAGATTCGATATTAGTAAAATGGGAAGCATTCCTGTGGAAGAACTTAGAGGCTTTT |
| TAAGAGGATATTTGTTTTACTTTGGAAAAGGAGAAAGAGACACATCTAAGATGAGGGTT |

-continued

```
TTAGAATCAGGTCGTTCTGACATAAAAGTTAAGAATATTACTGACATATCCCAGAAGAC
ACTGAGAATTGCTGATCTTCAAGGTAAAACAAGTTACCACCTGGTCTTGCGAGCCTATA
CAGATGGTGGAGTGGGCCCGGAGAAGAGTATGTATGTGGTGACAAAGGAAAATTCTGTG
GGATTAATTATTGCCATTCTCATCCCAGTGGCAGTGGCTGTCATTGTTGGAGTGGTGAC
AAGTATCCTTTGCTATCGGAAACGAGAATGGATTAAAGAAACCTTCTACCCTGATATTC
CAAATCCAGAAAACTGTAAAGCATTACAGTTTCAAAAGAGTGTCTGTGAGGGAAGCAGT
GCTCTTAAAACATTGGAAATGAATCCTTGTACCCCAAATAATGTTGAGGTTCTGGAAAC
TCGATCAGCATTTCCTAAAATAGAAGATACAGAAATAATTTCCCCAGTAGCTGAGCGTC
CTGAAGATCGCTCTGATGCAGAGCCTGAAAACCATGTGGTTGTGTCCTATTGTCCACCC
ATCATTGAGGAAGAAATACCAAACCCAGCCGCAGATGAAGCTGGAGGGACTGCACAGGT
TATTTACATTGATGTTCAGTCGATGTATCAGCCTCAAGCAAAACCAGAAGAAGAACAAG
AAAATGACCCTGTAGGAGGGGCAGGCTATAAGCCACAGATGCACCTCCCCATTAATTCT
ACTGTGGAAGATATAGCTGCAGAAGAGGACTTAGATAAAACTGCGGGTTACAGACCTCA
GGCCAATGTAAATACATGGAATTTAGTGTCTCCAGACTCTCCTAGATCCATAGACAGCA
ACAGTGAGATTGTCTCATTTGGAAGTCCATGCTCCATTAATTCCCGACAATTTTTGATT
CCTCCTAAAGATGAAGACTCTCCTAAATCTAATGGAGGAGGGTGGTCCTTTACAAACTT
TTTTCAGAACAAACCAAACGATTAACAGTGTCACCGTGTCACTTCAGTCAGCCATCTCA
ATAAGCTCTTACTGCTAGTGTTGCTACATCAGCACTGGGCATTCTTGGAGGGATCCTGT
GAAGTATTGTTAGGAGGTGAACTTCACTACATGTTAAGTTACACTGAAAGTTCATGTGC
TTTTAATGTAGTCTAAAAGCCAAAGTATAGTGACTCAGAATCCTCAATCCACAAAACTC
AAGATTGGGAGCTCTTTGTGATCAAGCCAAAGAATTCTCATGTACTCTACCTTCAAGAA
GCATTTCAAGGCTAATACCTACTTGTACGTACATGTAAAACAAATCCCGCCGCAACTGT
TTTCTGTTCTGTTGTTTGTGGTTTTCTCATATGTATACTTGGTGGAATTGTAAGTGGAT
TTGCAGGCCAGGGAGAAAATGTCCAAGTAACAGGTGAAGTTTATTTGCCTGACGTTTAC
TCCTTTCTAGATGAAAACCAAGCACAGATTTTAAAACTTCTAAGATTATTCTCCTCTAT
CCACAGCATTCACNNNNNNNNNNNNNNNNNNNNNGTAGTGACAGCGATTTAGTGTTTT
GTTTGATAAAGTATGCTTATTTCTGTGCCTACTGTATAATGGTTATCAAACAGTTGTCT
CAGGGGTACAAACTTTGAAAACAAGTGTGACACTGACCAGCCCAAATCATAATCATGTT
TTCTTGCTGTGATAGGTTTTGCTTGCCTTTTCATTATTTTTAGCTTTTATGCTTGCTT
CCATTATTTCAGTTGGTTGCCCTAATATTTAAAATTTACACTTCTAAGACTAGAGACCC
ACATTTTTTAAAAATCATTTTATTTTGTGATACAGTGACAGCTTTATATGAGCAAATTC
AATATTATTCATAAGCATGTAATTCCAGTGACTTACTATGTGAGATGACTACTAAGCAA
TATCTAGCAGCGTTAGTTCCATATAGTTCTGATTGGATTTCGTTCCTCCTGAGGAGACC
ATGCCGTTGAGCTTGGCTACCCAGGCAGTGGTGATCTTTGACACCTTCTGGTGGATGTT
CCTCCCACTCATGAGTCTTTTCATCATGCCACATTATCTGATCCAGTCCTCACATTTTT
AAATATAAAACTAAAGAGAGAATGCTTCTTACAGGAACAGTTACCCAAGGGCTGTTTCT
TAGTAACTGTCATAAACTGATCTGGATCCATGGGCATACCTGTGTTCGAGGTGCAGCAA
TTGCTTGGTGAGCTGTGCAGAATTGATTGCCTTCAGCACAGCATCCTCTGCCCACCCTT
GTTTCTCATAAGCGATGTCTGGAGTGATTGTGGTTCTTGGAAAAGCAGAAGGAAAAACT
AAAAAGTGTATCTTGTATTTTCCCTGCCCTCAGGTTGCCTATGTATTTTACCTTTTCAT
ATTTAAGGCAAAAGTACTTGAAAATTTTAAGTGTCCGAATAAGATATGTCTTTTTTGTT
TGTTTTTTTTGGTTGGTTGTTTGTTTTTTATCATCTGAGATTCTGTAATGTATTTGCAA
ATAATGGATCAATTAATTTTTTTTGAAGCTCATATTGTATCTTTTTAAAAACCATGTTG
TGGAAAAAAGCCAGAGTGACAAGTGACAAAATCTATTTAGGAACTCTGTGTATGAATCC
TGATTTTAACTGCTAGGATTCAGCTAAATTTCTGAGCTTTATGATCTGTGGAAATTTGG
AATGAAATCGAATTCATTTTGTACATACATAGTATATTAAAACTATATAATAGTTCAT
                                                   AAAAAAAAAA
A.
```

The length of this sequence was determined using batch, automated computational methods and the sequence, as sense strand, its length, and the desired location of the probe sequence near the 3' end of the mRNA was submitted to Array Designer Ver 1.1 (Premier Biosoft International, Palo Alto, Calif.). Search quality was set at 100%, number of best probes set at 1, length range set at 50 base pairs, Target Tm set at 75 C. degrees plus or minus 5 degrees, Hairpin max deltaG at 6.0-kcal/mol., Self dimmer max deltaG at 6.0-kcal/mol, Run/repeat (dinucleotide) max length set at 5, and Probe site minimum overlap set at 1. When none of the 49 possible probes met the criteria, the probe site would be moved 50 base pairs closer to the 5' end of the sequence and resubmitted to Array Designer for analysis. When no possible probes met the criteria, the variation on melting temperature was raised to plus and minus 8 degrees and the number of identical base-pairs in a run increased to 6 so that a probe sequence was produced.

In the sequence above, using the criteria noted above, Array Designer Ver 1.1 designed a probe corresponding to oligonucleotide number 2280 in Table 8 and is indicated by underlining in the sequence above. It has a melting temperature of 68.4 degrees Celsius and a max run of 6 nucleotides and represents one of the cases where the criteria for probe design in Array Designer Ver 1.1 were relaxed in order to obtain an oligonucleotide near the 3' end of the mRNA (Low melting temperature was allowed).

Clone 463D12

Clone 463D 12 was sequenced and compared to the nr, dbEST, and UniGene databases at NCBI using the BLAST search tool. The sequence matched accession number AI184553, an EST sequence with the definition line "qd60a05.x1 Soares_testis_NHT Homo sapiens cDNA clone IMAGE:1733840 3' similar to gb:M29550 PROTEIN PHOSPHATASE 2B CATALYTIC SUBUNIT 1 (HUMAN);, mRNA sequence." The E value of the alignment was $1.00 \times 10^{-118}$. The GenBank sequence begins with a poly-T region, suggesting that it is the antisense strand, read 5' to 3'. The beginning of this sequence is complementary to the 3' end of the mRNA sense strand. The accession number for this sequence was included in a text file of accession numbers representing antisense sequences. Sequences for antisense strand mRNAs were obtained by uploading a text file containing desired accession numbers as an Entrez search query using the Batch Entrez web interface and saving the results locally as a FASTA file. The following sequence was obtained, and the region of alignment of clone 463D12 is outlined:

```
TTTTTTTTTTTTTCTTAAATAGCATTTATTTTCTCTCAAAAAGCCTATTATGTACTAA      (SEQ ID NO: 8829)
CAAGTGTTCCTCTAAATTAGAAAGGCATCACTACTAAAATTTTATACATATTTTTATA
TAAGAGAAGGAATATTGGGTTACAATCTGAATTTCTCTTTATGATTTCTCTTAAAGTAT
AGAACAGCTATTAAAATGACTAATATTGCTAAAATGAAGGCTACTAAATTTCCCCAAGA
ATTTCGGTGGAATGCCCAAAAATGGTGTTAAGATATGCAGAAGGGCCCATTTCAAGCAA
AGCAATCTCTCCACCCCTTCATAAAAGATTTAAGCTAAAAAAAAAAAAAAAAGAAGAAA
ATCCAACAGCTGAAGACATTGGGCTATTTATAAATCTTCTCCCAGTCCCCCAGACAGCC
TCACATGGGGGCTGTAAACAGCTAACTAAAATATCTTTGAGACTCTTATGTCCACACCC
ACTGACACAAGGAGAGCTGTAACCACAGTGAAACTAGACTTTGCTTTCCTTTAGCAAGT
ATGTGCCTATGATAGTAAACTGGAGTAAATGTAACAGTAATAAAACAAATTTTTTTTAA
AAATAAAAATTATACCTTTTTCTCCAACAAACGGTAAAGACCACGTGAAGACATCCATA
AAATTAGGCAACCAGTAAAGATGTGGAGAACCAGTAAACTGTCGAAATTCATCACATTA
TTTTCATACTTTAATACAGCAGCTTTAATTATTGGAGAACATCAAAGTAATTAGGTGCC
GAAAAACATTGTTATTAATGAAGGGAACCCCTGACGTTTGACCTTTTCTGTACCATCTA
TAGCCCTGGACTTGA
```

The FASTA file, including the sequence of AA184553, was then masked using the RepeatMasker web interface, as shown below. The region of alignment of clone 463D12 is outlined.

```
TTTTTTTTTTTTTCTTAAATAGCATTTATTTTCTCTCAAAAAGCCTATTATGTACTAA      (SEQ ID NO: 8830)
CAAGTGTTCCTCTAAATTAGAAAGGCATCACTACNNNNNNNNNNNNNNNNNNNNNNNN
NNNNGAGAAGGAATATTGGGTTACAATCTGAATTTCTCTTTATGATTTCTCTTAAAGTAT
AGAACAGCTATTAAAATGACTAATAT[masked]
[masked]AAAAATGGTGTTAAGATATGCAGAAGGGCCCATTTCAAGCAA
AGCAATCTCTCCACCCCTTCATAAAAGATTTAAGCTAAAAAAAAAAAAAAAAGAAGAAA
ATCCAACAGCTGAAGACATTGGGCTATTTATAAATCTTCTCCCAGTCCCCCAGACAGCC
TCACATGGGGGCTGTAAACAGCTAACTAAAATATCTTTGAGACTCTTATGTCCACACCC
ACTGACACAAGGAGAGCTGTAACCACAGTGAAACTAGACTTTGCTTTCCTTTAGCAAGT
ATGTGCCTATGATAGTAAACTGGAGTAAATGTAACAGNNNNNNNNNNNNNNNNNNNNNN
NNNNNNNNNNNNNCCTTTTTCTCCAACAAACGGTAAAGACCACGTGAAGACATCCATA
AAATTAGGCAACCAGTAAAGATGTGGAGAACCAGTAAACTGTCGAAATTCATCACATTA
TTTTCATACTTTAATACAGCAGCTTTAATTATTGGAGAACATCAAAGTAATTAGGTGCC
GAAAAACATTGTTATTAATGAAGGGAACCCCTGACGTTTGACCTTTTCTGTACCATCTA
TAGCCCTGGACTTGA   Masked version of 463D12 sequence.
```

The sequence was submitted to Array Designer as described above, however, the desired location of the probe was indicated at base pair 50 and if no probe met the criteria, moved in the 3' direction. The complementary sequence from Array Designer was used, because the original sequence was antisense. The oligonucleotide designed by Array Designer corresponds to oligonucleotide number 4342 in Table 8 and is complementary to the underlined sequence above. The probe has a melting temperature of 72.7 degrees centigrade and a max run of 4 nucleotides.

Clone 72D4

Clone 72D4 was sequenced and compared to the nr, dbEST, and UniGene databases at NCBI using the BLAST search tool. No significant matches were found in any of these databases. When compared to the human genome draft, significant alignments were found to three consecutive regions of the reference sequence NT_008060, as depicted below, suggesting that the insert contains three spliced exons of an unidentified gene.

Residue Numbers on Matching Residue

| clone 72D4 sequence numbers on NT_008060 | |
|---|---|
| 1-198 | 478646-478843 |
| 197-489 | 479876-480168 |
| 491-585 | 489271-489365 |

Because the reference sequence contains introns and may represent either the coding or noncoding strand for this gene, BioCardia's own sequence file was used to design the oligonucleotide. Two complementary probes were designed to ensure that the sense strand was represented. The sequence of the insert in clone 72D4 is shown below, with the three putative exons outlined.

```
CAGGTCACACAGCACATCAGTGGCTACATGTGAGCTCAGACCTGGGTCTGCT     (SEQ ID NO: 8545)
GCTGTCTGTCTTCCCAATATCCATGACCTTGACTGATGCAGGTGTCTAGGGAT
ACGTCCATCCCCGTCCTGCTGGAGCCCAGAGCACGGAAGCCTGGCCCTCCGA
GGAGACAGAAGGGAGTGTCGGACACCATGACGAGAGCTTGGCAGAATAAAT
AACTTCTTTAAACAATTTTACGGCATGAAGAAATCTGGACCAGTTTATTAAAT
GGGATTTCTGCCACAAACCTTGGAAGAATCACATCATCTTANNCCCAAGTGA
AAACTGTGTTGCGTAACAAAGAACATGACTGCGCTCCACACATACATCATTG
CCCGGCGAGGCGGGACACAAGTCAACGACGGAACACTTGAGACAGGCCTAC
AACTGTGCACGGGTCAGAAGCAAGTTTAAGCCATACTTGCTGCAGTGAGACT
ACATTTCTGTCTATAGAAGAT A CCTGACTTGATCTGTTTTTCAGCTCCAGTTC
CCAGATGTGCGTGTTGTGGTCCCCAAGTATCACCTTCCAATTTCTGGGAGCA
GTGCTCTGGCCG GATCCTTGCCGCGCGGATAAAAACT
```

The sequence was submitted to RepeatMasker, but no repetitive sequences were found. The sequence shown above was used to design the two 50-mer probes using Array Designer as described above. The probes are shown in bold typeface in the sequence depicted below. The probe in the sequence is oligonucleotide number 6415 (SEQ ID NO: 6415) in Table 8 and the complementary probe is oligonucleotide number 6805 (SEQ ID NO:6805).

```
CAGGTCACACAGCACATCAGTGGCTACATGTGAGCTCAGACCTGGGTCTGCTGCTGTCT

GTCTTCCCAATATCCATGACCTTGACTGATGCAGGTGTCTAGGGATACGTCCATCCCCG

TCCTGCTGGAGCCCAGAGCACGGAAGCCTGGCCCTCCGAGGAGACAGAAGGGAGTGTCG

GACACCATGACGAGAGCTTGGCAGAATAAATAACTTCTTTAAACAATTTTACGGCATGA

AGAAATCTGGACCAGTTTATTAAATGGGATTTCTGCCACAAACCTTGGAAGAATCACAT

CATCTTANNCCCAAGTGAAAACTGTGTTGCGTAACAAAGAACATGACTGCGCTCCACAC

ATACATCATTGCCCGGCGAGGCGGGACACAAGTCAACGACGGAACACTTGAGACAGGCC

TACAACTGTGCACGGGTCAGAAGCAAGTTTAAGCCATACTTGCTGCAGTGAGACTACAT

TTCTGTCTATAGAAGATACCTGACTTGATCTGTTTTTCAGCTCCAGTTCCCAGATGTGC
```

```
                            -continued
                  ←----3'-GTCAAGGGTCTACACG
GTGTTGTGGTCCCCAAGTATCACCTTCCAATTTCTGGGAG---→

CACAACACCAGGGGTTCATAGTGGAAGGTTAAAG-5' (SEQ ID NO: 6805)

CAGTGCTCTGGCCGGATCCTTGCCGCGCGGATAAAAACT---→ (SEQ ID NO: 8545)
```

Confirmation of Probe Sequence

Following probe design, each probe sequence was confirmed by comparing the sequence against dbEST, the UniGene cluster set, and the assembled human genome using BLASTn at NCBI. Alignments, accession numbers, gi numbers, UniGene cluster numbers and names were examined and the most common sequence used for the probe. The final probe set was compiled into Table 8. In this table, the sequence ID is given which corresponds to the sequence listing. The origin of the sequence for inclusion on the array is noted as coming from one of the cDNA libraries described in example 1, mining from databases as described in examples 2 and 11 or identification from the published literature. The unigene number, genebank accession and GI number are also given for each sequence when known. The name of the gene associated with the accession number is noted. The strand is noted as −1 or 1, meaning that the probe was designed from the complement of the sequence (−1) or directly from the sequence (1). Finally, the nucleotide sequence of each probe is also given.

Example 13

Production of an array of 8000 spotted 50mer oligonucleotides

We produced an array of 8000 spotted 50mer oligonucleotides. Examples 11 and 12 exemplify the design and selection of probes for this array.

Sigma-Genosys (The Woodlands, Tex.) synthesized unmodified 50-mer oligonucleotides using standard phosphoramidite chemistry, with a starting scale of synthesis of 0.05 μmole (see, e.g., R. Meyers, ed. (1995) *Molecular Biology and Biotechnology: A Comprehensive Desk Reference*). Briefly, to begin synthesis, a 3' hydroxyl nucleoside with a dimethoxytrityl (DMT) group at the 5' end was attached to a solid support. The DMT group was removed with trichloroacetic acid (TCA) in order to free the 5'-hydroxyl for the coupling reaction. Next, tetrazole and a phosphoramidite derivative of the next nucleotide were added. The tetrazole protonates the nitrogen of the phosphoramidite, making it susceptible to nucleophilic attack. The DMT group at the 5'-end of the hydroxyl group blocks further addition of nucleotides in excess. Next, the inter-nucleotide linkage was converted to a phosphotriester bond in an oxidation step using an oxidizing agent and water as the oxygen donor. Excess nucleotides were filtered out and the cycle for the next nucleotide was started by the removal of the DMT protecting group. Following the synthesis, the oligo was cleaved from the solid support. The oligonucleotides were desalted, resuspended in water at a concentration of 100 or 200 μM, and placed in 96-deep well format. The oligonucleotides were re-arrayed into Whatman Uniplate 384-well polyproylene V bottom plates. The oligonucleotides were diluted to a final concentration 30 μM in 1× Micro Spotting Solution Plus (Telechem/arrayit.com, Sunnyvale, Calif.) in a total volume of 15 μl. In total, 8,031 oligonucleotides were arrayed into twenty-one 384-well plates.

Arrays were produced on Telechem/arrayit.com Super amine glass substrates (Telechem/arrayit.com), which were manufactured in 0.1 mm filtered clean room with exact dimensions of 25×76×0.96 mm. The arrays were printed using the Virtek Chipwriter with a Telechem 48 pin Micro Spotting Printhead. The Printhead was loaded with 48 Stealth SMP3B TeleChem Micro Spotting Pins, which were used to print oligonucleotides onto the slide with the spot size being 110-115 microns in diameter.

Example 14

Amplification, Labeling, and Hybridization of Total RNA to an Oligonucleotide Microarray Amplification, Labeling, Hybridization and Scanning Samples consisting of at least 2 μg of intact total RNA were further processed for array hybridization. Amplification and labeling of total RNA samples was performed in three successive enzymatic reactions. First, a single-stranded DNA copy of the RNA was made (hereinafter, "ss-cDNA"). Second, the ss-cDNA was used as a template for the complementary DNA strand, producing double-stranded cDNA (hereinafter, "ds-cDNA, or cDNA"). Third, linear amplification was performed by in vitro transcription from a bacterial $T_7$ promoter. During this step, fluorescent-conjugated nucleotides were incorporated into the amplified RNA (hereinafter, "aRNA").

The first strand cDNA was produced using the Invitrogen kit (Superscript II). The first strand cDNA was produced in a reaction composed of 50 mM Tris-HCl (pH 8.3), 75 mM KCl, and 3 mM $MgCl_2$ (1× First Strand Buffer, Invitrogen), 0.5 mM dGTP, 0.5 mM dATP, 0.5 mM dTTP, 0.5 mM dCTP, 10 mM DTT, 10 U reverse transcriptase (Superscript II, Invitrogen, #18064014), 15 U RNase inhibitor (RNAGuard, Amersham Pharmacia, #27-0815-01), 5 μM T7T24 primer (5'-GGCCAGTGAATTGTAATACGACTCACTATAGGGAGG CGGTTTTTTTTTTTT TTTTTTTTTTTT-3'), (SEQ ID NO:8831) and 2 μg of selected sample total RNA. Several purified, recombinant control mRNAs from the plant *Arabidopsis thaliana* were added to the reaction mixture: 2-20 pg of the following genes CAB, RCA, LTP4, NAC1, RCP1, XCP2, RBCL, LTP6, TIM, and PRKase (Stratagene, #252201, #252202, #252204, #252208, #252207, #252206, #252203, #252205, #252209, #252210 respectively). The control RNAs allow the estimate of copy numbers for individual mRNAs in the clinical sample because corresponding sense oligonucleotide probes for each of these plant genes are present on the microarray. The final reaction volume of 20 μl was incubated at 42° C. for 60 min.

For synthesis of the second cDNA strand, DNA polymerase and RNase were added to the previous reaction, bringing the final volume to 150 μl. The previous contents were diluted and new substrates were added to a final concentration of 20 mM Tris-HCl (pH 7.0) (Fisher Scientific, Pittsburgh, Pa. #BP1756-100), 90 mMKCl (Teknova, Half Moon Bay, Calif., #0313-500), 4.6 mM $MgCl_2$ (Teknova, Half Moon Bay, Calif., #0304-500), 10 mM$(NH_4)_2SO_4$ (Fisher Scientific

A702-500)(1× Second Strand buffer, Invitrogen), 0.266 mM dGTP, 0.266 mM dATP, 0.266 mM dTTP, 0.266 mM dCTP, 40 U E. coli DNA polymerase (Invitrogen, #18010-025), and 2 U RNaseH (Invitrogen, #18021-014). The second strand synthesis took place at 16° C. for 120 minutes.

Following second-strand synthesis, the ds-cDNA was purified from the enzymes, dNTPs, and buffers before proceeding to amplification, using phenol-chloroform extraction followed by ethanol precipitation of the cDNA in the presence of glycogen.

Alternatively, a silica-gel column is used to purify the cDNA (e.g. Qiaquick PCR cleanup from Qiagen, #28104). The cDNA was collected by centrifugation at >10,000×g for 30 minutes, the supernatant is aspirated, and 150 μl of 70% ethanol, 30% water was added to wash the DNA pellet. Following centrifugation, the supernatant was removed, and residual ethanol was evaporated at room temperature.

Linear amplification of the cDNA was performed by in vitro transcription of the cDNA. The cDNA pellet from the step described above was resuspended in 7.4 μl of water, and in vitro transcription reaction buffer was added to a final volume of 20 μl containing 7.5 mM GTP, 7.5 mM ATP, 7.5 mM TTP, 2.25 mM CTP, 1.025 mM Cy3-conjugated CTP (PerkinElmer; Boston, Mass., #NEL-580), 1× reaction buffer (Ambion, Megascript Kit, Austin, Tex. and #1334) and 1% $T_7$ polymerase enzyme mix (Ambion, Megascript Kit, Austin, Tex. and #1334). This reaction was incubated at 37° C. overnight. Following in vitro transcription, the RNA was purified from the enzyme, buffers, and excess NTPs using the RNeasy kit from Qiagen (Valencia, Calif.; # 74106) as described in the vendor's protocol. A second elution step was performed and the two eluates were combined for a final volume of 60 μl. RNA is quantified using an Agilent 2100 bioanalyzer with the RNA 6000 nano LabChip.

Reference RNA was prepared as described above, except Cy5-CTP was incorporated instead of Cy3CTP. Reference RNA from five reactions, each reaction started with 2 ug total RNA, was pooled together and quantitated as described above.

Hybridization to an Array

RNA was prepared for hybridization as follows: for an 18 mm×55 mm array, 20 μg of amplified RNA (aRNA) was combined with 20 μg of reference aRNA. The combined sample and reference aRNA was concentrated by evaporating the water to 10 μl in a vacuum evaporator. The sample was fragmented by heating the sample at 95° C. for 30 minutes to fragment the RNA into 50-200.bp pieces. Alternatively, the combined sample and reference aRNA was concentrated by evaporating the water to 5 μl in a vacuum evaporator. Five μl of 20 mM zinc acetate was added to the aRNA and the mix incubated at 60° C. for 10 minutes. Following fragmentation, 40 μl of hybridization buffer was added to achieve final concentrations of 5×SSC and 0.20% SDS with 0.1 μg/μl of Cot-1 DNA (Invitrogen) as a competitor DNA. The final hybridization mix was heated to 98° C., and then reduced to 50° C. at 0.1° C. per second.

Alternatively, formamide is included in the hybridization mixture to lower the hybridization temperature.

The hybridization mixture was applied to a pre-heated 65° C. microarray, surface, covered with a glass coverslip (Corning, #2935-246), and placed on a pre-heated 65° C. hybridization chamber (Telechem, AHC-10). 15 ul of 5×SSC was placed in each of the reservoir in the hybridization chamber and the chamber was sealed and placed in a water bath at 62° C. for overnight (16-20 hrs). Following incubation, the slides were washed in 2×SSC, 0.1% SDS for five minutes at 30° C., then in 2×SSC for five minutes at 30° C., then in 2×SSC for another five minutes at 30° C., then in 0.2×SSC for two minutes at room temperature. The arrays were spun at 1000×g for 2 minutes to dry them. The dry microarrays are then scanned by methods described above.

The microarrays were imaged on the Agilent (Palo Alto, Calif.) scanner G2565AA. The scan settings using the Agilent software were as follows: for the PMT Sensitivity (100% Red and 100% Green); Scan Resolution (10 microns); red and green dye channels; used the default scan region for all slides in the carousel; using the largest scan region; scan date for Instrument ID; and barcode for Slide ID. The full image produced by the Agilent scanner was flipped, rotated, and split into two images (one for each signal channel) using TIFFSplitter (Agilent, Palo Alto, Calif.). The two channels are the output at 532 nm (Cy3-labeled sample) and 633 nm (Cy5-labeled R50). The individual images were loaded into GenePix 3.0 (Axon Instruments, Union City, Calif.) for feature extraction, each image was assigned an excitation wavelength corresponding the file opened; Red equals 633 nm and Green equals 532 nm. The setting file (gal) was opened and the grid was laid onto the image so that each spot in the grid overlaped with >50% of the feature. Then the GenePix software was used to find the features without setting minimum threshold value for a feature. For features with low signal intensity, GenePix reports "not found". For all features, the diameter setting was adjusted to include only the feature if necessary.

The GenePix software determined the median pixel intensity for each feature ($F_i$) and the median pixel intensity of the local background for each feature ($B_i$) in both channels. The standard deviation ($SDF_i$ and $SDB_i$) for each is also determined. Features for which GenePix could not discriminate the feature from the background were "flagged" as described below.

Following feature extraction into a .gpr file, the header information of the .gpr file was changed to carry accurate information into the database. An Excel macro was written to change the headers. The steps in that macro were:

1. Open .gpr file.
2. Check the value in the first row, first column. If it is "ATF", then the header has likely already been reformatted. The file is skipped and the user is alerted. Otherwise, proceed through the following steps.
3. Store the following values in variables.
    a. Name of .tif image file: parsed from row 11.
    b. SlideID: parsed from name of .tif image file.
    c. Version of the feature extraction software: parsed from row 25
    d. GenePix Array List file: parsed from row 6
    e. GenePix Settings file: parsed from row 5
4. Delete rows 1-8, 10-12, 20, 22, and 25.
5. Arrange remaining values in rows 15-29.
6. Fill in rows 1-14 with the following:
    Row 1 ScanID (date image file was last modified, formatted as yyyy.mm.dd-hh.mm.ss)
    Row 2 SlideID, from stored value
    Row 3 Name of person who scanned the slide, from user input
    Row 4 Image file name, from stored value
    Row 5 Green PMT setting, from user input
    Row 6 Red PMT setting, from user input
    Row 7 ExtractID (date .gpr file was created, formatted as yyyy.mm.dd-hh.mm.ss)
    Row 8 Name of person who performed the feature extraction, from user input
    Row 9 Feature extraction software used, from stored value
    Row 10 Results file name (same as the .gpr file name)

Row 11 GenePix Array List file, from stored value
Row 12 GenePix Settings file, from stored value
Row 13 StorageCD, currently left blank
Row 14 Extraction comments, from user input (anything about the scanning or feature extraction of the image the user feels might be relevant when selecting which hybridizations to include in an analysis)

Pre-Processing with Excel Templates

Following analysis of the image and extraction of the data, the data from each hybridization was pre-processed to extract data that was entered into the database and subsequently used for analysis. The complete GPR file produced by the feature extraction in GenePix was imported into an excel file pre-processing template. The same excel template was used to process each GPR file. The template performs a series of calculations on the data to differentiate poor features from others and to combine triplicate feature data into a single data point for each probe.

Each GPR file contained 31 rows of header information, followed by rows of data for 24093 features. The last of these rows was retained with the data. Rows 31 through the end of the file were imported into the excel template. Each row contained 43 columns of data. The only columns used in the pre-processing were: Oligo ID, F633 Median (median value from all the pixels in the feature for the Cy5 dye), B633 Median (the median value of all the pixels in the local background of the selected feature for Cy5), B633 SD (the standard deviation of the values for the pixels in the local background of the selected feature for Cy5), F532 Median (median value from all the pixels in the feature for the Cy3 dye), B532 Median (the median value of all the pixels in the local background of the selected feature for Cy3), B532 SD (the standard deviation of the values for the pixels in the local background of the selected feature for Cy3), and Flags. The GenePix Flags column contains the flags set during feature extraction. "−75" indicates there were no features printed on the array in that position, "−50" indicates that GenePix could not differentiate the feature signal from the local background, and "−100" indicates that the user marked the feature as bad.

Once imported, the rows with −75 flags were deleted. Then the median of B633 SD and B532 SD were calculated over all features with a flag value of "0". The minimum values of B633 Median and B532 Median were identified, considering only those values associated with a flag value of "0". For each feature, the signal to noise ratio (S/N) was calculated for both dyes by taking the fluorescence signal minus the local background (BGSS) and dividing it by the standard deviation of the local background:

$$S/N = \frac{F_i - B_i}{SDB_i}$$

If the S/N was less than 3, then an adjusted background-subtracted signal was calculated as the fluorescence minus the minimum local background on the slide. An adjusted S/N was then calculated as the adjusted background subtracted signal divided by the median noise over all features for that channel. If the adjusted S/N was greater than three and the original S/N were less than three, a flag of 25 was set for the Cy5 channel, a flag of 23 was set for the Cy3 channel, and if both met these criteria, then a flag of 20 was set. If both the adjusted S/N and the original S/N were less than three, then a flag of 65 was set for Cy5, 63 set for Cy3, and 60 set if both dye channels had an adjusted S/N less than three. All signal to noise calculations, adjusted background-subtracted signal, and adjusted S/N were calculated for each dye channel. If the BGSS value was greater than or equal to 64000, a flag was set to indicate saturation; 55 for Cy5, 53 for Cy3, 50, for both.

The BGSS used for further calculations was the original BGSS if the original S/N was greater than or equal to three. If the original S/N ratio was less than three and the adjusted S/N ratio was greater than or equal to three, then the adjusted BGSS was used. If the adjusted S/N ratio was less than three, then the adjusted BGSS was used, but with knowledge of the flag status.

To facilitate comparison among arrays, the Cy3 and Cy5 data were scaled to have a median of 1. For each dye channel, the median value of all features with flags=0,20,23, or 25 was calculated. The BGSS for each dye in each feature was then divided by this median value. The Cy3/Cy5 ratio was calculated for each feature using the scaled $$R_n = \frac{Cy3S_i}{Cy5S_i}$$

The flag setting for each feature was used to determine the expression ratio for each probe, a combination of three features. If all three features had flag settings in the same category (categories=negatives, 0 to 25, 50-55, and 60-65), then the average and CV of the three feature ratios was calculated. If the CV of all three features was less than 15, the average was used. If the CV was greater than 15, then the CV of each combination of two of the features was calculated and the two features with the lowest CV were averaged. If none of the combinations of two features had a CV less than 15, then the median ratio of the three features was used as the probe feature.

If the three features do not have flags in the same category, then the features with the best quality flags were used (0>25>23>20>55>53>50>65>63>60). Features with negative flags were never used. When the best flags were two features in the same category, the average was used. If a single feature had a better flag category than the other two then that feature was used.

Once the probe expression ratio was calculated from the three features, the log of the ratio was taken as described below and stored for use in analyzing the data. Whichever features were used to calculate the probe value, the worst of the flags from those features was carried forward and stored as the flag value for that probe. 2 different data sets can be used for analysis. Flagged data uses all values, including those with flags. Filtered data sets are created by removing flagged data from the set before analysis.

Example 15

Real-Time PCR Validation of Array Expression Results

In example 10, leukocyte gene expression was used to discover expression markers and diagnostic gene sets for clinical outcomes. It is desirable to validate the gene expression results for each gene using a more sensitive and quantitative technology such as real-time PCR. Further, it is possible for the diagnostic nucleotide sets to be implemented as a diagnostic test as a real-time PCR panel. Alternatively, the quantitative information provided by real-time PCR validation can be used to design a diagnostic test using any alternative quantitative or semi-quantitative gene expression technology.

To validate the results of the microarray experiments we used real-time, or kinetic, PCR. In this type of experiment the amplification product is measured during the PCR reaction. This enables the researcher to observe the amplification before any reagent becomes rate limiting for amplification. In kinetic PCR the measurement is of $C_T$ (threshold cycle) or $C_P$ (crossing point). This measurement ($C_T=C_P$) is the point at which an amplification curve crosses a threshold fluorescence value. The threshold is set to a point within the area where all of the reactions were in their linear phase of amplification. When measuring $C_T$, a lower $C_T$ value is indicative of a higher amount of starting material since an earlier cycle number means the threshold was crossed more quickly.

Several fluorescence methodologies are available to measure amplification product in real-time PCR. Taqman (Applied BioSystems, Foster City, Calif.) uses fluorescence resonance energy transfer (FRET) to inhibit signal from a probe until the probe is degraded by the sequence specific binding and Taq 3' exonuclease activity. Molecular Beacons (Stratagene, La Jolla, Calif.) also use FRET technology, whereby the fluorescence is measured when a hairpin structure is relaxed by the specific probe binding to the amplified DNA. The third commonly used chemistry is Sybr Green, a DNA-binding dye (Molecular Probes, Eugene, Oreg.). The more amplified product that is produced, the higher the signal. The Sybr Green method is sensitive to non-specific amplification products, increasing the importance of primer design and selection. Other detection chemistries can also been used, such as ethedium bromide or other DNA-binding dyes and many modifications of the fluorescent dye/quencher dye Taqman chemistry, for example scorpions.

Initially, samples are chosen for validation, which have already been used for microarray based expression analysis. They are also chosen to represent important disease classes or disease criteria. For the first steps of this example (primer design, primer endpoint testing, and primer efficiency testing) we examined M-actin and β-GUS. These genes are considered "housekeeping" genes because they are required for maintenance in all cells. They are commonly used as a reference that is expected to not change with experimental treatment. We chose these two particular genes as references because they varied the least in expression across 5 mRNA samples examined by real-time PCR.

The inputs for real time PCR reaction are gene-specific primers, cDNA from specific patient samples, and the standard reagents. The cDNA was produced from mononuclear RNA (prepared as in example 7) by reverse transcription using OligodT primers (Invitrogen, 18418-012) and random hexamers (Invitrogen, 48190-011) at a final concentration of 0.5 ng/µl and 3 ng/µl respectively. For the first strand reaction mix, 1.45 µg/µl of total RNA (R50, universal leukocyte reference RNA as described in Example 8) and 1 µl of the Oligo dT/Random Hexamer Mix, were added to water to a final volume of 11.5 µl. The sample mix was then placed at 70° C. for 10 minutes. Following the 70° C. incubation, the samples were chilled on ice, spun down, and 88.5 µl of first strand buffer mix dispensed into the reaction tube. The final first strand buffer mix produced final concentrations of 1× first strand buffer (Invitrogen, Y00146, Carlsbad, Calif.), 0.01 mM DTT (Invitrogen, Y00147), 0.1 mM dATP (NEB, N0440S, Beverly, Mass.), 0.1 mM dGTP (NEB, N0442S), 0.1 mM dTTP (NEB, N0443S), 0.1 mM dCTP (NEB, N0441 S), 2 U of reverse transcriptase (Superscript II, Invitrogen, 18064-014), and 0.18 U of RNase inhibitor (RNAGaurd Amersham Pharmacia, 27-0815-01, Piscataway, N.J.). The reaction was incubated at 42° C. for 1 hour. After incubation the enzyme was heat inactivated at 70° C. for 15 minutes, 1 µl of RNAse H added to the reaction tube, and incubated at 37° C. for 20 minutes.

Primer Design

Two methods were used to design primers. The first was to use the software, Primer Express™ and recommendations for primer design that are provided with the GeneAmp® 7700 Sequence Detection System supplied by Applied BioSystems (Foster City, Calif.). The second method used to design primers was the PRIMER3 ver 0.9 program that is available from the Whitehead Research Institute, Cambridge, Mass. The program can also be accessed on the World Wide Web at: genome.wi.mit.edu/cgi-bin/primer/primer3_www.cgi. Primers and Taqman/hybridization probes were designed as described below using both programs.

The Primer Express literature explains that primers should be designed with a melting temperature between 58 and 60 degrees C. while the Taqman probes should have a melting temperature of 68 to 70 under the salt conditions of the supplied reagents. The salt concentration is fixed in the software. Primers should be between 15 and 30 basepairs long. The primers should produce and amplicon in size between 50 and 150 base pairs, have a C-G content between 20% and 80%, have no more than 4 identical base pairs next to one another, and no more than 2 C's and G's in the last 5 bases of the 3' end. The probe cannot have a G on the 5' end and the strand with the fewest G's should be used for the probe.

Primer3 has a large number of parameters. The defaults were used for all except for melting temperature and the optimal size of the amplicon was set at 100 bases. One of the most critical is salt concentration as it affects the melting temperature of the probes and primers. In order to produce primers and probes with melting temperatures equivalent to Primer Express, a number of primers and probes designed by Primer Express were examined using PRIMER3. Using a salt concentration of 50 mM these primers had an average melting temperature of 3.7 degrees higher than predicted by Primer Express. In order to design primers and probes with equivalent melting temperatures as Primer Express using PRIMER3, a melting temperature of 62.7 plus/minus 1.0 degree was used in PRIMER3 for primers and 72.7 plus/minus 1.0 degrees for probes with a salt concentration of 50 mM.

The C source code for Primer3 was downloaded and complied on a Sun Enterprise 250 server using the GCC complier. The program was then used from the command line using a input file that contained the sequence for which we wanted to design primers and probes along with the input parameters as described by help files that accompany the software. Using scripting it was possible to input a number of sequences and automatically generate a number of possible probes and primers.

Primers for β-Actin (Beta Actin, Genbank Locus: NM_001101) and β-GUS: glucuronidase, beta, (GUSB, Genbank Locus: NM-000181), two reference genes, were designed using both methods and are shown here as examples.

The first step was to mask out repetitive sequences found in the mRNA sequences using RepeatMasker program that can be accessed at the web site located at repeatmasker.genome.washington.edu/cgi-bin/RepeatMasker (Smit, AFA & Green, P "RepeatMasker" at the web site located at ftp.genome.washington.edu/RM/RepeatMasker.html).

The last 500 basepairs on the last 3' end of masked sequence was then submitted to PRIMER3 using the following exemplary input file:

PRIMER_SEQUENCE_ID => ACTB Beta Actin

PRIMER_EXPLAIN_FLAG = 1

PRIMER_MISPRIMING_LIBRARY =

SEQUENCE = TTGGCTTGACTCAGGATTTAAAAACTGGAACGGTGAAGGTGACAGCAGTCGGTTGGACGAGC   (SEQ ID NO: 8833)
ATCCCCCAAAGTTCACAATGTGGCCGAGGACTTTGATTGCACATTGTTGTTTTTAATAGTCATTCCAAAT
ATGAGATGCATTGTTACAGGAAGTCCCTTGCCATCCTAAAAGCACCCCACTTCTCTCTAAGGAGAATGGCC
CAGTCCTCTCCCAAGTCCACACAGGGGAGGGATAGCATTGCTTTCGTGTAAATTATGTAATGCAAAATTTT
TTTAATCTTCGCCTTAATCTTTTTTATTTTGTTTTATTTTGAATGATGAGCCTTCGTGCCCCCCCTTCCCC
CTTTTTTCCCCCAACTTGAGATGTATGAAGGCTTTTGGTCTCCCTGGGAGTGGGTGGAGGCAGCCGGGCTT
ACCTGTACACTGACTTGAGACCAGTTGAATAAAAGTGCACACCTTA

PRIMER_PRODUCT_OPT_SIZE = 100

PRIMER_NUM_RETURN = 100

PRIMER_MAX_END_STABILITY = 9.0

PRIMER_MAX_MISPRIMING = 12.00

PRIMER_PAIR_MAX_MISPRIMING = 24.00

PRIMER_MIN_SIZE = 18

PRIMER_OPT_SIZE = 20

PRIMER_MAX_SIZE = 32

PRIMER_MIN_TM = 61.7

PRIMER_OPT_TM = 62.7

PRIMER_MAX_TM = 63.7

PRIMER_MAX_DIFF_TM = 100.0

PRIMER_MIN_GC = 20.0

PRIMER_MAX_GC = 80.0

PRIMER_SELF_ANY = 8.00

PRIMER_SELF_END = 3.00

PRIMER_NUM_NS_ACCEPTED = 0

PRIMER_MAX_POLY_X = 4

PRIMER_OUTSIDE_PENALTY = 0

PRIMER_GC_CLAMP = 0

PRIMER_SALT_CONC = 50.0

PRIMER_DNA_CONC = 50.0

PRIMER_LIBERAL_BASE = 1

PRIMER_MIN_QUALITY = 0

PRIMER_MIN_END_QUALITY = 0

PRIMER_QUALITY_RANGE_MIN = 0

PRIMER_QUALITY_RANGE_MAX = 100

PRIMER_WT_TM_LT = 1.0

PRIMER_WT_TM_GT = 1.0

PRIMER_WT_SIZE_LT = 1.0

-continued

```
PRIMER_WT_SIZE_GT = 1.0
PRIMER_WT_GC_PERCENT_LT = 0.0
PRIMER_WT_GC_PERCENT_GT = 0.0
PRIMER_WT_COMPL_ANY = 0.0
PRIMER_WT_COMPL_END = 0.0
PRIMER_WT_NUM_NS = 0.0
PRIMER_WT_REP_SIM = 0.0
PRIMER_WT_SEQ_QUAL = 0.0
PRIMER_WT_END_QUAL = 0.0
PRIMER_WT_POS_PENALTY = 0.0
PRIMER_WT_END_STABILITY = 0.0
PRIMER_PAIR_WT_PRODUCT_SIZE_LT = 0.05
PRIMER_PAIR_WT_PRODUCT_SIZE_GT = 0.05
PRIMER_PAIR_WT_PRODUCT_TM_LT = 0.0
PRIMER_PAIR_WT_PRODUCT_TM_GT = 0.0
PRIMER_PAIR_WT_DIFF_TM = 0.0
PRIMER_PAIR_WT_COMPL_ANY = 0.0
PRIMER_PAIR_WT_COMPL_END = 0.0
PRIMER_PAIR_WT_REP_SIM = 0.0
PRIMER_PAIR_WT_PR_PENALTY = 1.0
PRIMER_PAIR_WT_IO_PENALTY = 0.0
PRIMER_INTERNAL_OLIGO_MIN_SIZE = 18
PRIMER_INTERNAL_OLIGO_OPT_SIZE = 20
PRIMER_INTERNAL_OLIGO_MAX_SIZE = 35
PRIMER_INTERNAL_OLIGO_MIN_TM = 71.7
PRIMER_INTERNAL_OLIGO_OPT_TM = 72.7
PRIMER_INTERNAL_OLIGO_MAX_TM = 73.7
PRIMER_INTERNAL_OLIGO_MIN_GC = 20.0
PRIMER_INTERNAL_OLIGO_MAX_GC = 80.0
PRIMER_INTERNAL_OLIGO_SELF_ANY = 12.00
PRIMER_INTERNAL_OLIGO_SELF_END = 12.00
PRIMER_INTERNAL_OLIGO_NUM_NS = 0
PRIMER_INTERNAL_OLIGO_MAX_POLY_X = 5
PRIMER_INTERNAL_OLIGO_MISHYB_LIBRARY =
PRIMER_INTERNAL_OLIGO_MAX_MISHYB = 12.00
PRIMER_INTERNAL_OLIGO_MIN_QUALITY = 0
PRIMER_INTERNAL_OLIGO_SALT_CONC = 50.0
PRIMER_INTERNAL_OLIGO_DNA_CONC = 50.0
PRIMER_IO_WT_TM_LT = 1.0
PRIMER_IO_WT_TM_GT = 1.0
```

-continued

PRIMER_IO_WT_SIZE_LT = 1.0

PRIMER_IO_WT_SIZE_GT = 1.0

PRIMER_IO_WT_GC_PERCENT_LT = 0.0

PRIMER_IO_WT_GC_PERCENT_GT = 0.0

PRIMER_IO_WT_COMPL_ANY = 0.0

PRIMER_IO_WT_NUM_NS = 0.0

PRIMER_IO_WT_REP_SIM = 0.0

PRIMER_IO_WT_SEQ_QUAL = 0.0

PRIMER_TASK = pick_pcr_primers_and_hyb_probe

PRIMER_PRODUCT_SIZE_RANGE = 50-150

PRIMER_FIRST_BASE_INDEX = 1

PRIMER_PICK_ANYWAY = 1

=

PRIMER_SEQUENCE_ID => GUSB

PRIMER_EXPLAIN_FLAG = 1

PRIMER_MISPRIMING_LIBRARY =

SEQUENCE = GAAGAGTACCAGAAAAGTCTGCTAGAGCAGTACCATCTGGGTCTGGATCAAAAACGCAGAAA (SEQ ID NO: 8834)

ATATGTGGTTGGAGAGCTCATTTGGAATTTTGCCGATTTCATGACTGAACAGTCACCGACGAGAGTGCTGG

GGAATAAAAAGGGGATCTTCACTCGGCAGAGACAACCAAAAAGTGCAGCGTTCCTTTTGCGAGAGAGATAC

TGGAAGATTGCCAATGAAACCAGGTATCCCCACTCAGTAGCCAAGTCACAATGTTTGGAAAACAGCCCGTT

TACTTGAGCAAGACTGATACCACCTGCGTGTCCCTTCCTCCCCGAGTCAGGGCGACTTCCACAGCAGCAGA

ACAAGTGCCTCCTGGACTGTTCACGGCAGACCAGAACGTTTCTGGCCTGGGTTTTGTGGTCATCTATTCTA

GCAGGGAACACTAAAGGTGGAAATAAAAGATTTTCTATTATGGAAATAAAGAGTTGGCATGAAAGTCGCTA

CTG

PRIMER_PRODUCT_OPT_SIZE = 100

PRIMER_NUN_RETURN = 100

PRIMER_MAX_END_STABILITY = 9.0

PRIMER_MAX_MISPRIMING = 12.00

PRIMER_PAIR_MAX_MISPRIMING = 24.00

PRIMER_MIN_SIZE = 18

PRIMER_OPT_SIZE = 20

PRIMER_MAX_SIZE = 32

PRIMER_MIN_TM = 61.7

PRIMER_OPT_TM = 62.7

PRIMER_MAX_TM = 63.7

PRIMER_MAX_DIFF_TM = 100.0

PRIMER_MIN_GC = 20.0

PRIMER_MAX_GC = 80.0

PRIMER_SELF_ANY = 8.00

PRIMER_SELF_END = 3.00

-continued

```
PRIMER_NUM_NS_ACCEPTED = 0
PRIMER_MAX_POLY_X = 4
PRIMER_OUTSIDE_PENALTY = 0
PRIMER_GC_CLAMP = 0
PRIMER_SALT_CONC = 50.0
PRIMER_DNA_CONC = 50.0
PRIMER_LIBERAL_BASE = 1
PRIMER_MIN_QUALITY = 0
PRIMER_MIN_END_QUALITY = 0
PRIMER_QUALITY_RANGE_MIN = 0
PRIMER_QUALITY_RANGE_MAX = 100
PRIMER_WT_TM_LT = 1.0
PRIMER_WT_TM_GT = 1.0
PRIMER_WT_SIZE_LT = 1.0
PRIMER_WT_SIZE_GT = 1.0
PRIMER_WT_GC_PERCENT_LT = 0.0
PRIMER_WT_GC_PERCENT_GT = 0.0
PRIMER_WT_COMPL_ANY = 0.0
PRIMER_WT_COMPL_END = 0.0
PRIMER_WT_NUM_NS = 0.0
PRIMER_WT_REP_SIM = 0.0
PRIMER_WT_SEQ_QUAL = 0.0
PRIMER_WT_END_QUAL = 0.0
PRIMER_WT_POS_PENALTY = 0.0
PRIMER_WT_END_STABILITY = 0.0
PRIMER_PAIR_WT_PRODUCT_SIZE_LT = 0.05
PRIMER_PAIR_WT_PRODUCT_SIZE_GT = 0.05
PRIMER_PAIR_WT_PRODUCT_TM_LT = 0.0
PRIMER_PAIR_WT_PRODUCT_TM_GT = 0.0
PRIMER_PAIR_WT_DIFF_TM = 0.0
PRIMER_PAIR_WT_COMPL_ANY = 0.0
PRIMER_PAIR_WT_COMPL_END = 0.0
PRIMER_PAIR_WT_REP_SIM = 0.0
PRIMER_PAIR_WT_PR_PENALTY = 1.0
PRIMER_PAIR_WT_IO_PENALTY = 0.0
PRIMER_INTERNAL_OLIGO_MIN_SIZE = 18
PRIMER_INTERNAL_OLIGO_OPT_SIZE = 20
PRIMER_INTERNAL_OLIGO_MAX_SIZE = 35
PRIMER_INTERNAL_OLIGO_MIN_TM = 71.7
PRIMER_INTERNAL_OLIGO_OPT_TM = 72.7
```

```
PRIMER_INTERNAL_OLIGO_MAX_TM = 73.7

PRIMER_INTERNAL_OLIGO_MIN_GC = 20.0

PRIMER_INTERNAL_OLIGO_MAX_GC = 80.0

PRIMER_INTERNAL_OLIGO_SELF_ANY = 12.00

PRIMER_INTERNAL_OLIGO_SELF_END = 12.00

PRIMER_INTERNAL_OLIGO_NUM_NS = 0

PRIMER_INTERNAL_OLIGO_MAX_POLY_X = 5

PRIMER_INTERNAL_OLIGO_MISHYB_LIBRARY =

PRIMER_INTERNAL_OLIGO_MAX_MISHYB = 12.00

PRIMER_INTERNAL_OLIGO_MIN_QUALITY = 0

PRIMER_INTERNAL_OLIGO_SALT_CONC = 50.0

PRIMER_INTERNAL_OLIGO_DNA_CONC = 50.0

PRIMER_IO_WT_TM_LT = 1.0

PRIMER_IO_WT_TM_GT = 1.0

PRIMER_IO_WT_SIZE_LT = 1.0

PRIMER_IO_WT_SIZE_GT = 1.0

PRIMER_IO_WT_GC_PERCENT_LT = 0.0

PRIMER_IO_WT_GC_PERCENT_GT = 0.0

PRIMER_IO_WT_COMPL_ANY = 0.0

PRIMER IO_WT_NUM_NS = 0.0

PRIMER_IO_WT_REP_SIM = 0.0

PRIMER_IO_WT_SEQ_QUAL = 0.0

PRIMER_TASK = pick_pcr_primers_and_hyb_probe

PRIMER_PRODUCT_SIZE_RANGE = 50-150

PRIMER_FIRST_BASE_INDEX = 1

PRIMER_PICK_ANYWAY = 1

=
```

After running PRIMER3, 100 sets of primers and probes were generated for ACTB and GUSB. From this set, nested primers were chosen based on whether both left primers could be paired with both right primers and a single Taqman probe could be used on an insert of the correct size. With more experience we have decided not use the mix and match approach to primer selection and just use several of the top pairs of predicted primers.

For ACTB this turned out to be:

```
Forward 75   CACAATGTGGCCGAGGACTT, (SEQ ID NO: 8835)

Forward 80   TGTGGCCGAGGACTTTGATT, (SEQ ID NO: 8836)

Reverse 178  TGGCTTTTAGGATGGCAAGG, (SEQ ID NO: 8837)
and

Reverse 168  GGGGGCTTAGTTTGCTTCCT. (SEQ ID NO: 8838)
```

Upon testing, the F75 and R178 pair worked best.

For GUSB the following primers were chosen:

```
Forward 59   AAGTGCAGCGTTCCTTTTGC, (SEQ ID NO: 8839)

Forward 65   AGCGTTCCTTTTGCGAGAGA, (SEQ ID NO: 8840)

Reverse 158  CGGGCTGTTTTCCAAACATT  (SEQ ID NO: 8841)
and

Reverse 197  GAAGGGACACGCAGGTGGTA. (SEQ ID NO: 8842)
```

No combination of these GUSB pairs worked well.

In addition to the primer pairs above, Primer Express predicted the following primers for GUSB: Forward 178 TAC-CACCTGCGTGTCCCTTC (SEQ ID NO: 8843) and Reverse 242 GAGGCACTTGTTCTGCTGCTG (SEQ ID NO: 8844). This pair of primers worked to amplify the GUSB mRNA.

The parameters used to predict these primers in Primer Express were:

Primer Tm: min 58, Max=60, opt 59, max difference=2 degrees

Primer GC: min=20% Max=80% no 3' G/C clamp

Primer: Length: min=9 max=40 opt=20

Amplicon: min Tm=0 max Tm=85
min=50 bp max=150 bp

Probe: Tm 10 degrees>primers, do not begin with a G on 5' end

Other: max base pair repeat=3
max number of ambiguous residues=0
secondary structure: max consec bp=4, max total bp=8
Uniqueness: max consec match=9
max % match=75
max 3' consecutive match=7

Using this approach, multiple primers were designed for genes that were shown to have expression patterns that correlated with clinical data in example 10. These primer pairs are shown in Table 10B and are added to the sequence listing. Primers can be designed from any region of a target gene using this approach.

Granzyme B is an important marker of CMV infection and transplant rejection. For Granzyme B the following sequence (NM_004131) was used as input for Primer3:

```
                                          (SEQ ID No: 9086)
GGGGACTCTGGAGGCCCTCTTGTGTGTAACAAGGTGGCCCAGGGCATTGT

CTCCTATGGACGAAACAATGGCATGCCTCCACGAGCCTGCACCAAAGTCT

CAAGCTTTGTACACTGGATAAAGAAAACCATGAAACGCTACTAACTACAG

GAAGCAAACTAAGCCCCGCTGTAATGAAACACCTTCTCTGGAGCCAAGT

CCAGATTTACACTGGGAGAGGTGCCAGCAACTGAATAAATACCTCTCCCA

GTGTAAATCTGGAGCCAAGTCCAGATTTACACTGGGAGAGGTGCCAGCAA

CTGAATAAATACCTCTTAGCTGAGTGG
```

For Granzyme B the following primers were chosen for testing:

```
Forward 81   ACGAGCCTGCACCAAAGTCT   (SEQ ID No: 9087)

Forward 63   AAACAATGGCATGCCTCCAC   (SEQ ID No: 9088)

Reverse 178  TCATTACAGCGGGGCTTAG    (SEQ ID No: 9089)

Reverse 168  GGGGGCTTAGTTTGCTTCCT   (SEQ ID No: 9090)
```

Testing demonstrated that F81 and R178 worked well in amplifying a product.

Primer Endpoint Testing

Primers were first tested to examine whether they would produce the correct size product without non-specific amplification. The standard real-time PCR protocol was used without the Rox and Sybr green dyes. Each primer pair was tested on cDNA made from universal mononuclear leukocyte reference RNA that was produced from 50 individuals as described in Example 8 (R50).

The PCR reaction consisted of IX RealTime PCR Buffer (Ambion, Austin, Tex.), 3 mM MgCl2 (Applied BioSystems, B02953), 0.2 mM DATP (NEB), 0.2 mM dTTP (NEB), 0.2 mM dCTP (NEB), 0.2 mM dGTP (NEB), 1.25 U AmpliTaq Gold (Applied BioSystems, Foster City, Calif.), 0.3 µM of each primer to be used (Sigma Genosys, The Woodlands, Tex.), 5l of the R50 reverse-transcription reaction and water to a final volume of 19 µl.

Following 40 cycles of PCR, one microliter of the product was examined by agarose gel electrophoresis and on an Agilent Bioanalyzer, DNA1000 chip (Palo Alto, Calif.). Results for 2 genes are shown in FIG. 6. From the primer design and the sequence of the target gene, one can calculate the expected size of the amplified DNA product. Only primer pairs with amplification of the desired product and minimal amplification of contaminants were used for real-time PCR. Primers that produced multiple products of different sizes are likely not specific for the gene of interest and may amplify multiple genes or chromosomal loci.

Primer Optimization/Efficiency

Once primers passed the end-point PCR, the primers were tested to determine the efficiency of the reaction in a real-time PCR reaction. cDNA was synthesized from starting total RNA as described above. A set of 5 serial dilutions of the R50 reverse-transcribed cDNA (as described above) were made in water: 1:10, 1:20, 1:40, 1:80, and 1:160.

The Sybr Green real-time PCR reaction was performed using the Taqman PCR Reagent kit (Applied BioSystems, Foster City, Calif., N808-0228). A master mix was made that consisted of all reagents except the primes and template. The final concentration of all ingredients in the reaction was 1× Taqman Buffer A (Applied BioSystems), 2 mM MgCl2 (Applied BioSystems), 200 µM dATP (Applied BioSystems), 200 µM dCTP (Applied BioSystems), 200 µM dGTP (Applied BioSystems), 400 µM dUTP (Applied BioSystems), 1:400,000 diluted Sybr Green dye (Molecular Probes), 1.25 U AmpliTaq Gold (Applied BioSystems). The master mix for 92 reactions was made to a final volume of 2112 µl. 1012 µl of PCR master mix was dispensed into two, light-tight tubes. Each β-Actin primer F75 and R178 (Genosys), was added to one tube of PCR master mix and Each β-GUS primer F178 and R242 (Genosys), was added to the other tube of PCR master mix to a final primer concentration of 300 nM, and a final volume of 1035l per reaction tube. 45 µl of the β-Actin master mix was dispensed into 23 wells, in a 96well plate (Applied BioSystems). 45 µl of the β-GUS master mix was dispensed into 23 wells, in a 96well plate (Applied BioSystems). 5 µl of the template dilution series was dispensed into triplicate wells for each primer. The reaction was run on an ABI 7700 Sequence Detector (Applied BioSystems).

The Sequence Detector v1.7 software was used to analyze the fluorescent signal from each well. A threshold value was selected that allowed most of the amplification curves to cross the threshold during the linear phase of amplification. The cycle number at which each amplification curve crossed the threshold ($C_T$) was recorded and the file transferred to MS Excel for further analysis. The $C_T$ values for triplicate wells were averaged. The data were plotted as a function of the $\log_{10}$ of the calculated starting concentration of RNA. The starting RNA concentration for each cDNA dilution was determined based on the original amount of RNA used in the RT reaction, the dilution of the RT reaction, and the amount used (5 µl) in the real-time PCR reaction. For each gene, a linear regression line was plotted through all of the dilutions series points. The slope of the line was used to calculate the efficiency of the reaction for each primer set using the equation:

$$E = 10^{(-1/slope)}$$

Using this equation (Pfaffl 2001), the efficiency for these β-actin primers is 2.28 and the efficiency for these β-GUS primers is 2.14 (FIG. 2). This efficiency was used when comparing the expression levels among multiple genes and multiple samples. This same method was used to calculate reaction efficiency for primer pairs for each gene we studied.

Assay and Results

Once primers were designed and tested and efficiency analysis was completed, primers were used examine expression of a single gene among many clinical samples. The basic design was to examine expression of both the experimental gene and a reference gene in each sample and, at the same time, in a control sample. The control sample we used was the universal mononuclear leukocyte reference RNA described in example 8 (R50).

In this example, three patient samples from patients with known CMV infection were compared to three patient samples from patients with no diagnosis of CMV infection based on standard diagnostic algorithms for active CMV infection (including viral PCR assays, serologies, culture and other tests). cDNA was made from all six RNA samples and the R50 control as described above. The cDNA was diluted 1:10 in water and 5 µl of this dilution was used in the 50 µl PCR reaction. Each 96-well plate consisted of 32 reactions, each done in triplicate. There were 17 templates and 3 primer sets. The three primer sets were β-GUS, β-Actin, and Granzyme B AS described above. Each of the three primer sets was used to measure template levels in 8 templates: the six experimental samples, R50, and water (no-template control). The β-GUS primers were also used to measure template levels a set of 8 templates identical except for the absence of the reverse transcriptase enzyme in the cDNA synthesis reaction (−RT). The real-time PCR reactions were performed as described above in "primer optimization/efficiency".

Figure 7A:
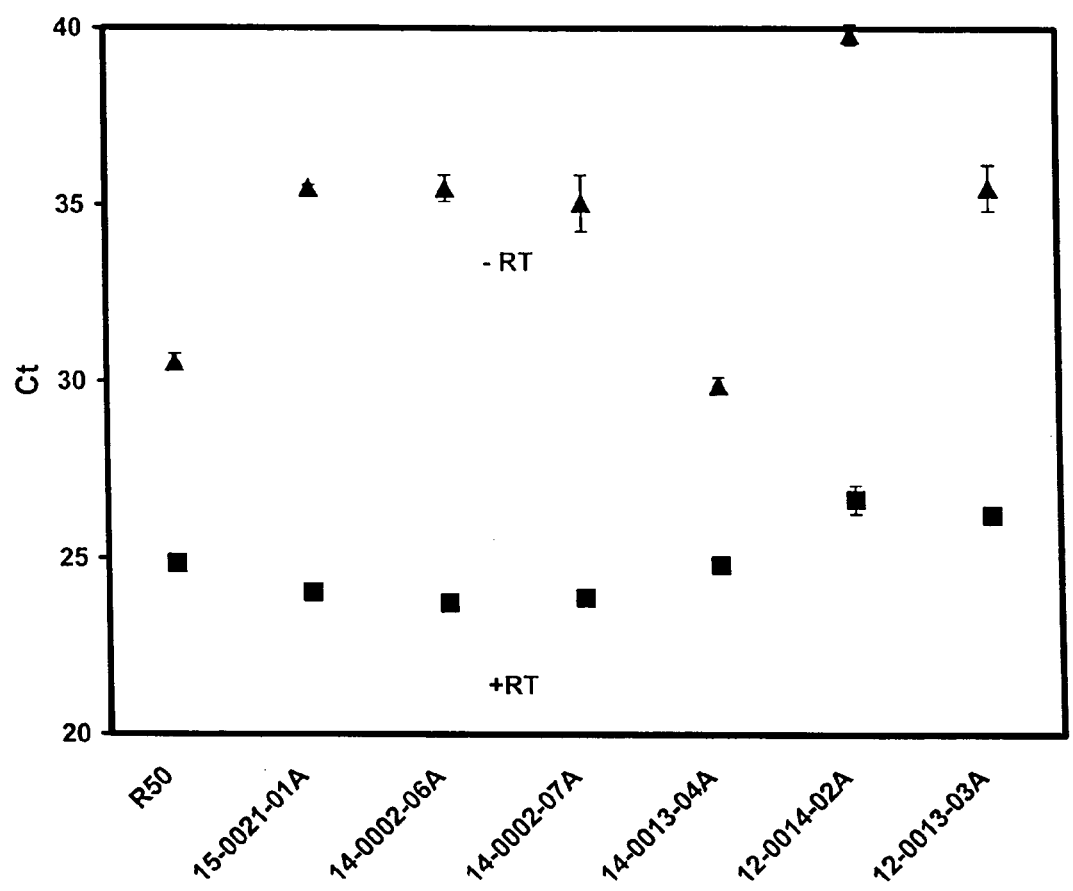
FIG. 7A shows the Ct for each patient sample on multiple assays is shown along with the Ct in the R50 control RNA. Triangles represent −RT (reverse transcriptase) controls.

The β-GUS amplification with +RT and −RT cDNA synthesis reaction templates were compared to measure the amount of genomic DNA contamination of the patient RNA sample (FIG. 7A). The only source of amplifiable material in the −RT cDNA synthesis reaction is contaminating genomic DNA. Separation by at least four $C_T$ between the −RT and +RT for each sample was required to consider the sample useful for analysis of RNA levels. Since a $C_T$ decrease of one is a two-fold increase in template, a difference of four $C_T$ would indicate that genomic DNA contamination level in the +RT samples was 6.25% of the total signal. Since we used these reactions to measure 30% or greater differences, a 6% contamination would not change the result.

For samples with sufficiently low genomic DNA contamination the data were used to identify differences in gene expression by measuring RNA levels. $C_T$ values from the triplicate wells for each reaction were averaged and the coefficient of variation (CV) determined. Samples with high CV (>2%) were examined and outlier reaction wells were discarded from further analysis. The average of the wells for each sample was taken as the $C_T$ value for each sample. For each gene, the ACT was the R50 control $C_T$ minus the sample $C_T$. The equation below was then used to identify an expression ratio compared to a reference gene (β-Actin) and control sample (R50) for Granzyme B expression in each experimental sample (Pfaffl, M. W. 2001). E is the amplification efficiency determined above.

$$\text{ratio} = \frac{(E_{target})^{\Delta C_T target(control-sample)}}{(E_{ref})^{\Delta C_T ref(control-sample)}}$$

Figure 7B:
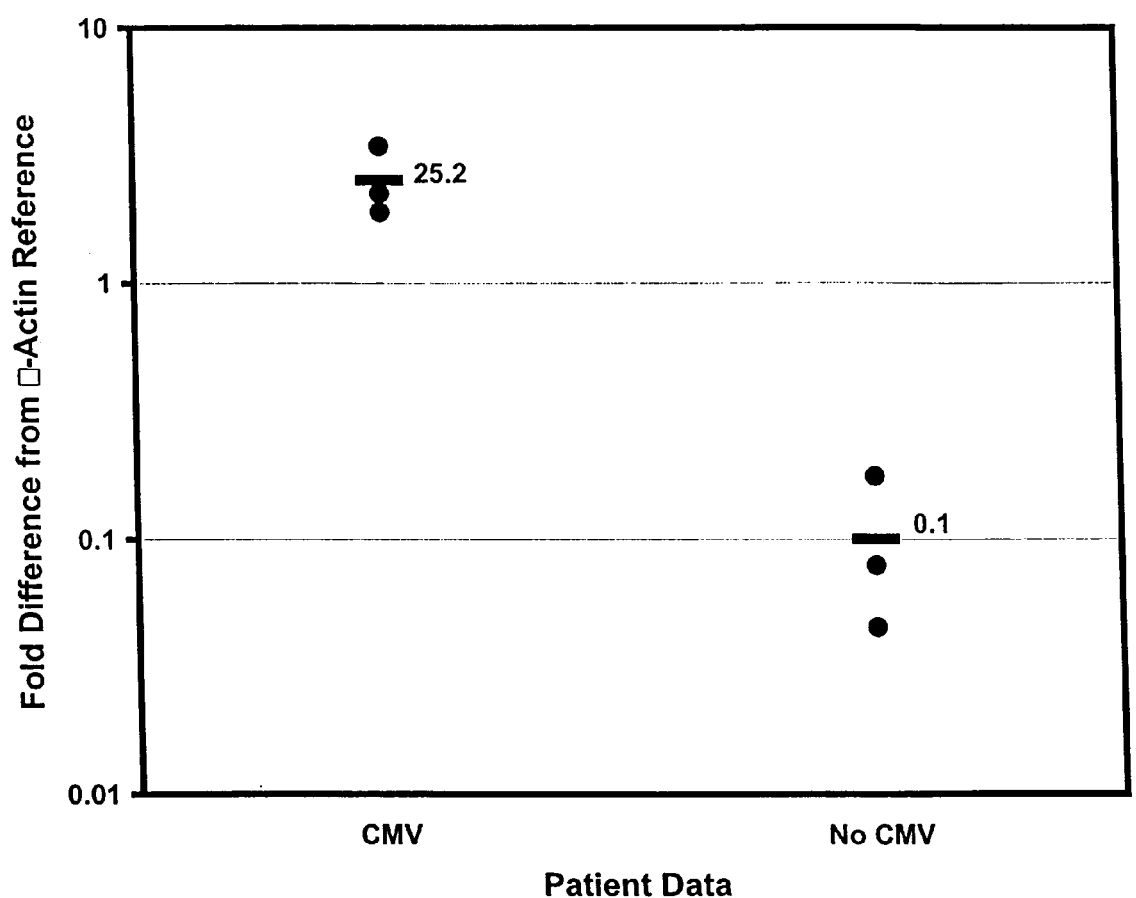
FIG. 7B shows the fold difference between the expression of Granzyme B and an Actin reference is shown for 3 samples from patients with and without CMV disease.

The complete experiment was performed in duplicate and the average of the two ratios taken for each gene. When β-Actin was used as the reference gene, the data show that Granzyme B is expressed at 25-fold higher levels in mononuclear cell RNA from patients with CMV than from patients without CMV (FIG. 7B). In this graph, each circle represents a patient sample and the black bars are the average of the three samples in each category.

Example 16

Correlation and Classification Analysis

After generation and processing of expression data sets from microarrays as described in Example 14, a log ratio value is used for most subsequent analysis. This is the logarithm of the expression ratio for each gene between sample and universal reference. The processing algorithm assigns a number of flags to data that are of low signal to noise or are in some other way of uncertain quality. Correlation analysis can proceed with all the data (including the flagged data) or can be done on filtered data sets where the flagged data is removed from the set. Filtered data should have less variability and may result in more significant results. Flagged data contains all information available and may allow discovery of genes that are missed with the filtered data set.

In addition to expression data, clinical data are included in the analysis. Continuous variables, such as the ejection fraction of the heart measured by echocardiography or the white blood cell count can be used for correlation analysis. In some cases, it may be desirable to take the logarithm of the values before analysis. These variables can be included in an analysis along with gene expression values, in which case they are treated as another "gene". Sets of markers can be discovered that work to diagnose a patient condition and these can include both genes and clinical parameters. Categorical variables such as male or female can also be used as variables for correlation analysis. For example, the sex of a patient may be an important splitter for a classification tree.

Clinical data are used as supervising vectors for the significance or classification analysis. In this case, clinical data associated with the samples are used to divide samples in to clinically meaningful diagnostic categories for correlation or classification analsysis. For example, pathologic specimens from kidney biopsies can be used to divide lupus patients into groups with and without kidney disease. A third or more categories can also be included (for example "unknown" or "not reported"). After generation of expression data and definition of using supervising vectors, correlation, significance and classification analysis is used to determine which set of genes are most appropriate for diagnosis and classification of patients and patient samples.

Significance Analysis for Microarrays (SAM)

Significance analysis for microarrays (SAM) (Tusher 2001) is a method through which genes with a correlation between their expression values and the response vector are statistically discovered and assigned a statistical significance. The ratio of false significant to significant genes is the False Discovery Rate (FDR). This means that for each threshold there are a set of genes which are called significant, and the FDR gives a confidence level for this claim. If a gene is called differentially expressed between 2 classes by SAM, with a FDR of 5%, there is a 95% chance that the gene is actually differentially expressed between the classes. SAM takes into account the variability and large number of variables of microarrays. SAM will identify genes that are most globally differentially expressed between the classes. Thus, important genes for identifying and classifying outlier samples or patients may not be identified by SAM.

After generation of data from patient samples and definition of categories using clinical data as supervising vectors, SAM is used to detect genes that are likely to be differentially expressed between the groupings. Those genes with the highest significance can be validated by real-time PCR (Example 15) or can be used to build a classification algorithm as described here.

Classification

Supervised harvesting of expression trees (Hastie 2001) identifies genes or clusters that best distinguish one class from all the others on the data set. The method is used to identify the genes/clusters that can best separate one class versus all the others for datasets that include two or more classes from each other. This algorithm can be used to identify genes that are used to create a diagnostic algorithm. Genes that are identified can be used to build a classification tree with algorithms such as CART.

CART is a decision tree classification algorithm (Breiman 1984). From gene expression and or other data, CART can develop a decision tree for the classification of samples. Each node on the decision tree involves a query about the expression level of one or more genes or variables. Samples that are above the threshold go down one branch of the decision tree and samples that are not go down the other branch. Genes from expression data sets can be selected for classification building using CART by significant differential expression in SAM analysis (or other significance test), identification by supervised tree-harvesting analysis, high fold change between sample groups, or known relevance to classification of the target diseases. In addition, clinical data can also be used as variables for CART that are of know importance to the clinical question or are found to be significant predictors by multivariate analysis or some other technique. CART identifies surrogates for each splitter (genes that are the next best substitute for a useful gene in classification). Analysis is performed in CART by weighting misclassification costs to optimize desired performance of the assay. For example, it may be most important the sensitivity of a test for a given diagnosis be near 100% while specificity is less important.

Once a set of genes and expression criteria for those genes have been established for classification, cross validation is done. There are many approaches, including a 10 fold cross validation analysis in which 10% of the training samples are left out of the analysis and the classification algorithm is built with the remaining 90%. The 10% are then used as a test set for the algorithm. The process is repeated 10 times with 10% of the samples being left out as a test set each time. Through this analysis, one can derive a cross validation error which helps estimate the robustness of the algorithm for use on prospective (test) samples. When a gene set is established for a diagnosis with a low cross validation error, this set of genes is tested using samples that were not included in the initial analysis (test samples). These samples may be taken from archives generated during the clinical study. Alternatively, a new prospective clinical study can be initiated, where samples are obtained and the gene set is used to predict patient diagnoses.

Lengthy table referenced here

US07579148-20090825-T00001

Please refer to the end of the specification for access instructions.

Lengthy table referenced here

US07579148-20090825-T00002

Please refer to the end of the specification for access instructions.

Lengthy table referenced here

US07579148-20090825-T00003

Please refer to the end of the specification for access instructions.

Lengthy table referenced here

US07579148-20090825-T00004

Please refer to the end of the specification for access instructions.

Lengthy table referenced here

US07579148-20090825-T00005

Please refer to the end of the specification for access instructions.

Lengthy table referenced here

US07579148-20090825-T00006

Please refer to the end of the specification for access instructions.

Lengthy table referenced here

US07579148-20090825-T00007

Please refer to the end of the specification for access instructions.

Lengthy table referenced here

US07579148-20090825-T00008

Please refer to the end of the specification for access instructions.

| Lengthy table referenced here |
|---|
| US07579148-20090825-T00009 |
| Please refer to the end of the specification for access instructions. |

| Lengthy table referenced here |
|---|
| US07579148-20090825-T00010 |
| Please refer to the end of the specification for access instructions. |

| Lengthy table referenced here |
|---|
| US07579148-20090825-T00011 |
| Please refer to the end of the specification for access instructions. |

| Lengthy table referenced here |
|---|
| US07579148-20090825-T00012 |
| Please refer to the end of the specification for access instructions. |

| Lengthy table referenced here |
|---|
| US07579148-20090825-T00013 |
| Please refer to the end of the specification for access instructions. |

| Lengthy table referenced here |
|---|
| US07579148-20090825-T00014 |
| Please refer to the end of the specification for access instructions. |

LENGTHY TABLES

The patent contains a lengthy table section. A copy of the table is available in electronic form from the USPTO web site (http://seqdata.uspto.gov/?pageRequest=docDetail&DocID=US07579148B2). An electronic copy of the table will also be available from the USPTO upon request and payment of the fee set forth in 37 CFR 1.19(b)(3).

SEQUENCE LISTING (9090 sequences)

SEQ ID NO: 1 - DNA, 50 bp, Homo sapiens
agagcacttgcagagcctgggacaacctccttattgaagggaagagggac

SEQ ID NO: 2 - DNA, 50 bp, Homo sapiens
tggtctcaaagatttacatggcaacattcgaaagtccccagagaagtcct

SEQ ID NO: 3 - DNA, 50 bp, Homo sapiens
aggacttctctggggactttcgaatgttgccatgtaaatctttgagacca

SEQ ID NO: 4 - DNA, 50 bp, Homo sapiens
aggtgccagcaactgaataaatacctctcccagtgtaaatctggagccaa

SEQ ID NO: 5 - DNA, 50 bp, Homo sapiens
gggtgtctttaaatagcactagccaaatcacatatctccaacactcctta

SEQ ID NO: 6 - DNA, 50 bp, Homo sapiens
taaggagtgttggagatatgtgatttggctagtgctatttaaagacaccc

SEQ ID NO: 7 - DNA, 50 bp, Homo sapiens
cccacagtgcaattcagaatatgctcagggaatgccagccaccttgtaaa

SEQ ID NO: 8 - DNA, 50 bp, Homo sapiens
gccaagacaataagctaggctactgggtccagctactactttggtgggat

SEQ ID NO: 9 - DNA, 50 bp, Homo sapiens
atcccaccaaagtagtagctggacccagtagcctagcttattgtcttggc

SEQ ID NO: 10 - DNA, 50 bp, Homo sapiens
aatttataactcctaggggttatttctgtgccagacacattccacctctc

SEQ ID NO: 11 - DNA, 50 bp, Homo sapiens
actaattgcattggcagcattgtgtctttgaccttgtatactagcttgac

SEQ ID NO: 12 - DNA, 50 bp, Homo sapiens
aaaccaaaaataatcacaacagaaaccagctgccccaaaggaaccagagg

SEQ ID NO: 13 - DNA, 50 bp, Homo sapiens
tcccaccaggactttgctaacaataatgtttggaaataaagaagtgctct

SEQ ID NO: 14 - DNA, 50 bp, Homo sapiens
tgacactcatgccaacaagaacctgtgcccctccttcctaacctgaggcc

SEQ ID NO: 15 - DNA, 50 bp, Homo sapiens
acaaattttaccctaacagttttaccacctagcaacagtcatttctgaaa

SEQ ID NO: 16 - DNA, 50 bp, Homo sapiens
tttattggtacttcctaaagatagagactaaagtcatggtagtattggcc

SEQ ID NO: 17 - DNA, 50 bp, Homo sapiens
ggccaatactaccatgactttagtctctatctttaggaagtaccaataaa

SEQ ID NO: 18 - DNA, 50 bp, Homo sapiens
cctcccattttgttctcggaagattaaatgctacatgtgtaagtctgcct

SEQ ID NO: 19 - DNA, 50 bp, Homo sapiens
ccgtgcccggaaacaggccgtggctagagaagagcgagatcatctttacc

SEQ ID NO: 20 - DNA, 50 bp, Homo sapiens
ggtctaatttattcaaagggggcaagaagtagcagtgtctgtaaaagagc

SEQ ID NO: 21 - DNA, 50 bp, Homo sapiens
agatgggtgaatcagttgggttttgtaaatacttgtatgtggggaagaca

SEQ ID NO: 22 - DNA, 50 bp, Homo sapiens
tctctagttgtcactttcctcttccactttgataccattgggtcattgaa

SEQ ID NO: 23 - DNA, 50 bp, Homo sapiens
tcaaaagaaagccttctggatgctgttaagatgtacccttcaggtgaacc

SEQ ID NO: 24 - DNA, 50 bp, Homo sapiens
ccccctttccttctaatttttcagctccttcaatgcaaagtacatgtatt

SEQ ID NO: 25 - DNA, 50 bp, Homo sapiens
cctccaaccccggaaacttcctgtgcaacccagactatcacctttgaaag

SEQ ID NO: 26 - DNA, 50 bp, Homo sapiens
ggaaggtagtcttcatttgcaatcaggaaaacgaacgtaaaggcacaggt

SEQ ID NO: 27 - DNA, 50 bp, Homo sapiens
acctgtgcctttacgttcgttttcctgattgcaaatgaagactaccttcc

SEQ ID NO: 28 - DNA, 50 bp, Homo sapiens
tgttttcctcactacattgtacatgtgggaattacagataaacggaagcc

SEQ ID NO: 29 - DNA, 50 bp, Homo sapiens
cagagcaagaccctgaagacccccaaccacggcctaaaagcctctttgtg

SEQ ID NO: 30 - DNA, 50 bp, Homo sapiens
gcttcatatgtatggctgttgctttgcttcatgtgtatggctatttgtat

SEQ ID NO: 31 - DNA, 50 bp, Homo sapiens
cagatgggttcagcagtctggtcagtgagaaagggccgagggtagacagg

SEQ ID NO: 32 - DNA, 50 bp, Homo sapiens
tccagggcaatcaatgttcacgcaacttgaaattatatctgtggtcttca

SEQ ID NO: 33 - DNA, 50 bp, Homo sapiens
tcatcccgagaacattggcttccacatcacagtatctacccttacatggt

SEQ ID NO: 34 - DNA, 50 bp, Homo sapiens
cgctctcgatattcctgtgcagaaacctggaccacgtctacaaccggctc

SEQ ID NO: 35 - DNA, 50 bp, Homo sapiens
cctgctcagctctgcataagtaattcaagaaatgggaggcttcaccttaa

SEQ ID NO: 36 - DNA, 50 bp, Homo sapiens
ggaggacccacactgctacacttctgatcccctttggttttactacccaa

SEQ ID NO: 37 - DNA, 50 bp, Homo sapiens
gaagaacagcagatggcggtgatcagcagagagattgaactttgaggagg

SEQ ID NO: 38 - DNA, 50 bp, Homo sapiens
ggaatttcctatcttgcagcatcctgtaaataaacattcaagtccaccct

SEQ ID NO: 39 - DNA, 50 bp, Homo sapiens
cctcaaagtgctaccgataaacctttctaattgtaagtgcccttactaag

SEQ ID NO: 40 - DNA, 50 bp, Homo sapiens
agtgggtcccagattggctcacactgagaatgtaagaactacaaacaaaa

SEQ ID NO: 41 - DNA, 50 bp, Homo sapiens
ctgtccagcgccaacagcctctatgacgacatcgagtgcttccttatgga

SEQ ID NO: 42 - DNA, 50 bp, Homo sapiens
aaattctggtaagtatgtgcttttctgtgggggtgggatttggaaggggg

SEQ ID NO: 43 - DNA, 50 bp, Homo sapiens
atgggtgaagagaaccgagcaaagatcaaaataaaaagtgacacagcagc

SEQ ID NO: 44 - DNA, 50 bp, Homo sapiens
gctgtgtccatctttgtcactgagtgaaatctctgttttctattctctga

SEQ ID NO: 45 - DNA, 50 bp, Homo sapiens
atgtgctgtcaaaacaagtttttctgtcaagaagatgatcagaccttgga

SEQ ID NO: 46 - DNA, 50 bp, Homo sapiens
cagtgatcagggtcctgcaagcagtggggaagggggccaaggtattggag

SEQ ID NO: 47 - DNA, 50 bp, Homo sapiens
tggacacacggatcaagaccaggaagaattgaacttgtcaaggtgaaggg

SEQ ID NO: 48 - DNA, 50 bp, Homo sapiens
aacagaccccctctagaaatttttcagatgcttctgggagacaccaaagg

SEQ ID NO: 49 - DNA, 50 bp, Homo sapiens
gtcagtaggtgcggtgtctagggtagtgaatcctgtaagttcaaatttat

SEQ ID NO: 50 - DNA, 60 bp, Homo sapiens
agttgtgtggtcagtaggtgcggtgtctagggtagtgaatcctgtaagttcaaatttatg

SEQ ID NO: 51 - DNA, 70 bp, Homo sapiens
tttaagttgtgtggtcagtaggtgcggtgtctagggtagtgaatcctgtaagttcaaatttatgattagg

SEQ ID NO: 52 - DNA, 50 bp, Homo sapiens
gtttgagatggacacactggtgtggattaacctgccagggagacagagct

SEQ ID NO: 53 - DNA, 50 bp, Homo sapiens
ttgtgactctgaatcccatgttctcaaactacgctgccttccgaagtctg

SEQ ID NO: 54 - DNA, 50 bp, Homo sapiens
tttaagtactaagtcatcatttgccttgaaagtttcctctgcattgggtt

SEQ ID NO: 55 - DNA, 50 bp, Homo sapiens
aacccaatgcagaggaaactttcaaggcaaatgatgacttagtacttaaa

SEQ ID NO: 56 - DNA, 50 bp, Homo sapiens
tacctgggcattcttgtttcattcaattccacctgcaatcaagtcctaca

SEQ ID NO: 57 - DNA, 60 bp, Homo sapiens
ccattaaacttacctgggcattcttgtttcattcaattccacctgcaatcaagtcctaca

SEQ ID NO: 58 - DNA, 70 bp, Homo sapiens
cacctgcaatcaagtcctacaagctaaaattagatgaactcaactttgacaaccatgagaccactgttat

SEQ ID NO: 59 - DNA, 50 bp, Homo sapiens
aatgcgtacgtttcctgagaagtgtctaaaaacaccaaaaagggatccgt

SEQ ID NO: 60 - DNA, 60 bp, Homo sapiens
acgtttcctgagaagtgtctaaaaacaccaaaaagggatccgtacattcaatgtttatgc

SEQ ID NO: 61 - DNA, 70 bp, Homo sapiens
caaatcaatgcgtacgtttcctgagaagtgtctaaaaacaccaaaaagggatccgtacattcaatgttta

SEQ ID NO: 62 - DNA, 50 bp, Homo sapiens
ctccgggagaggggacggtcaatcctgtgggtgaagacagagggaaacac

SEQ ID NO: 63 - DNA, 50 bp, Homo sapiens
ggctgggaaactgttggtggccagtgggtaataaagacctttcagtatcc

SEQ ID NO: 64 - DNA, 50 bp, Homo sapiens
tgctagaggggcttagagaactacaaggcctgcagaatttcccagagaag

SEQ ID NO: 65 - DNA, 50 bp, Homo sapiens
ctgactcaggatgacagacaggtggaactgccagtgtagagggaattcta

SEQ ID NO: 66 - DNA, 50 bp, Homo sapiens
gtaaaggctatacttgtcttgttcaccttgggatgacgccgcatgatatg

SEQ ID NO: 67 - DNA, 50 bp, Homo sapiens
caagcaggaagcacaaactcccccaagctgactcatcctaactaacagtc

SEQ ID NO: 68 - DNA, 50 bp, Homo sapiens
tcttcaacagaccccctctagaaatttttcagatgcttctgggagacacc

SEQ ID NO: 69 - DNA, 50 bp, Homo sapiens
gtcctccacgccatttccttttccttcaagcctagcccttctctcattat

SEQ ID NO: 70 - DNA, 50 bp, Homo sapiens
ggcccttcatgtacatccatggtgtgctggcttaaaatgtaattaatctt

SEQ ID NO: 71 - DNA, 50 bp, Homo sapiens
aagatgcccaaccctgtgatcagaacctccaaatactgccatgagaaact

SEQ ID NO: 72 - DNA, 50 bp, Homo sapiens
caggagtttgtgtgtcttttataaaaagtttgccctggatgtcatattgg

SEQ ID NO: 73 - DNA, 50 bp, Homo sapiens
ccctgagtgacagtcacgacagaacaaaaccacaagaccagaccacattt

SEQ ID NO: 74 - DNA, 50 bp, Homo sapiens
cctttacatccagataggttaccagtaacggaacatatccagtactcctg

SEQ ID NO: 75 - DNA, 50 bp, Homo sapiens
tgcatcgtaaaaccttcagaaggaaaggagaatgttttgtggaccacttt

SEQ ID NO: 76 - DNA, 50 bp, Homo sapiens
ggccactgaatgggtaggagcaaccactgactggtcttaagctgttcttg

SEQ ID NO: 77 - DNA, 50 bp, Homo sapiens
tgtagggtaaatgtgactggaatacacctttggaacggaattctttatca

SEQ ID NO: 78 - DNA, 50 bp, Homo sapiens
aggctggacatcggcccgctccccacaatgaaataaagttattttctcat

SEQ ID NO: 79 - DNA, 50 bp, Homo sapiens; identical to SEQ ID NO: 77

SEQ ID NO: 80 - DNA, 50 bp, Homo sapiens
gttgccatggtgatggtgtagccctcccactttgctgttccttactttac

SEQ ID NO: 81 - DNA, 50 bp, Homo sapiens
ccacccacccctcaattaaggcaacaatgaagttaatggataccctctgc

SEQ ID NO: 82 - DNA, 50 bp, Homo sapiens; identical to SEQ ID NO: 80

SEQ ID NO: 83 - DNA, 50 bp, Homo sapiens; identical to SEQ ID NO: 81

SEQ ID NO: 84 - DNA, 50 bp, Homo sapiens
gctcacctatttgggttaagcatgccaatttaaagagaccaagtgtatgt

SEQ ID NO: 85 - DNA, 50 bp, Homo sapiens
tccaccttttgtatttaattttaaagtcagtgtactgcaaggaagctgga

SEQ ID NO: 86 - DNA, 50 bp, Homo sapiens
ccctatcccgcaaaatgggcttcctgcctgggtttttctcttctcacatt

SEQ ID NO: 87 - DNA, 50 bp, Homo sapiens; identical to SEQ ID NO: 85

SEQ ID NO: 88 - DNA, 50 bp, Homo sapiens
agatcttcaagtgaacatctcttgccatcacctagctgcctgcacctgcc

SEQ ID NO: 89 - DNA, 50 bp, Homo sapiens
gctaattttaagcatgttcagtggcagctcccctccagtttcagtgtcac

SEQ ID NO: 90 - DNA, 50 bp, Homo sapiens
cctgtgatcaggctcccaagtctggttcccatgaggtgagatgcaacctg

SEQ ID NO: 91 - DNA, 50 bp, Homo sapiens
acatggtttgactcccgaacatcaccgacgtgtctcctgtttttctgggt

SEQ ID NO: 92 - DNA, 50 bp, Homo sapiens
tcagagctgaagaagcgagctggatggcaaggcctgtgcgacagataatg

SEQ ID NO: 93 - DNA, 50 bp, Homo sapiens
tcagccattttgggcatatgtatctttataatcagactggaaacgggact

SEQ ID NO: 94 - DNA, 50 bp, Homo sapiens
atcctggcaaccttacaattcctctcggcatttgtcacttccatctcagc

SEQ ID NO: 95 - DNA, 50 bp, Homo sapiens
agcttactacagtgaaagaatgggattggcaagtaacttctgacttactg

SEQ ID NO: 96 - DNA, 50 bp, Homo sapiens
attataacatcttcaacacagaacacactttgtggtcgaaaggctcagcc

SEQ ID NO: 97 - DNA, 50 bp, Homo sapiens
tgtcagagattgcctgtggctctaatatgcacctcaagattttaaggaga

SEQ ID NO: 98 - DNA, 50 bp, Homo sapiens
tgtctggcagggactgaatgacctgatgtcagatttagattcttcctggg

SEQ ID NO: 99 - DNA, 50 bp, Homo sapiens
gggaggaacactgcactcttaagcttccgccgtctcaacccctcacagga

SEQ ID NO: 100 - DNA, 50 bp, Homo sapiens
atgaagaagggtgtgaaggctgaacaatcatggatttttctgatcaattg

SEQ ID NO: 101 - DNA, 50 bp, Homo sapiens
gcctctgctccccagggagttgtgtctgtaatcggcctactattcagtgg

SEQ ID NO: 102 - DNA, 50 bp, Homo sapiens
ggatgctactgatgggaatgattaagggagctgctgtttaggtggtgctg

SEQ ID NO: 103 - DNA, 50 bp, Homo sapiens
tcaggaacaacatctactgcatggcccagctgctggacaactcagacacg

SEQ ID NO: 104 - DNA, 50 bp, Homo sapiens
cttacatcaggtactttgtcagcttcatcatccagttccagttccacgag

SEQ ID NO: 105 - DNA, 50 bp, Homo sapiens
catccaggagctgttcaagcgcatctccgagcagttcacggccatgttcc

SEQ ID NO: 106 - DNA, 50 bp, Homo sapiens
acctcccactttgtctgtacatactggcctctgtgattacatagatcagc

SEQ ID NO: 107 - DNA, 50 bp, Homo sapiens
gtctttgagaatatgatgtcagacattttcggatgggctgtttagatgtt

SEQ ID NO: 108 - DNA, 50 bp, Homo sapiens
ggtcacccaggaggatggcaaagagagtcgcatctcagtgcaggagagac

SEQ ID NO: 109 - DNA, 50 bp, Homo sapiens
agacccttatctggaggaggaagagaagcaggagagagaaagccacagcc

SEQ ID NO: 110 - DNA, 50 bp, Homo sapiens
ggctgtgtcctaaggcccatttgagaagctgaggctagttccaaaaacct

SEQ ID NO: 111 - DNA, 50 bp, Homo sapiens
gtgctcctgtaagtcaaatgtgtgctttgtactgctgttgttgaaattga

SEQ ID NO: 112 - DNA, 50 bp, Homo sapiens
cagagacataaagagaagatgccaaggccccctcctccacccaccgctaa

SEQ ID NO: 113 - DNA, 50 bp, Homo sapiens
atgggagtaataagagcagtggcagcagcatctctgaacatttctctgga

SEQ ID NO: 114 - DNA, 50 bp, Homo sapiens
ccactaatcctgatgaggctgacaaagttggggctgagaacacaatcacc

SEQ ID NO: 115 - DNA, 50 bp, Homo sapiens
tgttggggtttcctttaccttttctataagttgtaccaaaacatccactt

SEQ ID NO: 116 - DNA, 50 bp, Homo sapiens
cagagtaggcatctgggcaccaagaccttccctcaacagaggacactgag

SEQ ID NO: 117 - DNA, 50 bp, Homo sapiens
ctttgcctaaaccctatggcctcctgtgcatctgtactcaccctgtacca

SEQ ID NO: 118 - DNA, 50 bp, Homo sapiens; identical to SEQ ID NO: 76

SEQ ID NO: 119 - DNA, 50 bp, Homo sapiens
tgattctgcacttggggtctgtctgtacagttactcatgtcattgtaatg

SEQ ID NO: 120 - DNA, 50 bp, Homo sapiens
tgtgtaataggccttttcatgctttatgtgtagctttttacctgtaacct

SEQ ID NO: 121 - DNA, 50 bp, Homo sapiens
aagttatcatgtccatccgcaccaagctgcagaacaaggagcatgtgatt

SEQ ID NO: 122 - DNA, 50 bp, Homo sapiens; identical to SEQ ID NO: 121

SEQ ID NO: 123 - DNA, 50 bp, Homo sapiens
tggtggatgttaaaccaatattcctttcaactgctgcctgctagggaaaa

SEQ ID NO: 124 - DNA, 50 bp, Homo sapiens
tgaacttgctgaatgtaaggcaggctactatgcgttataatctaatcaca

SEQ ID NO: 125 - DNA, 50 bp, Homo sapiens
atttgaccagagcaaagctgaaaaatgaataactaaccccctttccctgc

SEQ ID NO: 126 - DNA, 60 bp, Homo sapiens
gcaattggagaactggatttgctgtttatgtctctgagaaatgcctgcatttgaccagag

SEQ ID NO: 127 - DNA, 70 bp, Homo sapiens
tttgaccagagcaaagctgaaaaatgaataactaaccccctttccctgctagaaataacaattagatgcc

SEQ ID NO: 128 - DNA, 50 bp, Homo sapiens
ccctttttgtcccccaacttgagatgtatgaaggcttttggtctccctgg

SEQ ID NO: 129 - DNA, 50 bp, Homo sapiens
attagaccagaccagtgtatttctaaagaaaatcctgacatgcacaccca

SEQ ID NO: 130 - DNA, 50 bp, Homo sapiens
gaccctactgctgatgataccagtgctgctgtaactgaagaaatgccacc

SEQ ID NO: 131 - DNA, 50 bp, Homo sapiens
acaggcaaagtgacaggggaaaaggaattagtctaagagtaaggggatga

SEQ ID NO: 132 - DNA, 50 bp, Homo sapiens
ctttcctcttgctgctggggcctaggtcttcttgctgctgcttccttttc

SEQ ID NO: 133 - DNA, 50 bp, Homo sapiens
agagtttttgttggtagactggagctgggatgttgaatcaacctcaggca

SEQ ID NO: 134 - DNA, 50 bp, Homo sapiens
tgcctgaggttgattcaacatcccagctccagtctaccaacaaaaactct

SEQ ID NO: 135 - DNA, 50 bp, Homo sapiens
ctgacgatcagcttggaacagccaaacagaattaacgcaactaataacct

SEQ ID NO: 136 - DNA, 50 bp, Homo sapiens
tccttttatgcattggaggaaaaacatgttggcttttctcttgacgtggg

SEQ ID NO: 137 - DNA, 50 bp, Homo sapiens
cccacgtcaagagaaaagccaacatgtttttcctccaatgcataaaagga

SEQ ID NO: 138 - DNA, 50 bp, Homo sapiens
ctcaggaaacccgacagaagaaacatgtaacacagaactcacgtccacta

SEQ ID NO: 139 - DNA, 50 bp, Homo sapiens
actcgagacgtaaattatggctgaatcatccgctaccttcacgccaatgg

SEQ ID NO: 140 - DNA, 50 bp, Homo sapiens
tgctgttttcattctgcatttgtgtagtttggtgctttgttccaagttaa

SEQ ID NO: 141 - DNA, 50 bp, Homo sapiens
aaaaatgacaaaagttatcaccaaaaccccctttcccatcttgcactgtt

SEQ ID NO: 142 - DNA, 50 bp, Homo sapiens
agcttttaatgctccaaatgctgacccatgcaatatttcctcatgtgatc

SEQ ID NO: 143 - DNA, 50 bp, Homo sapiens
aaaagaaatgcaggtttattatccagcactgagagagttaacaaggactg

SEQ ID NO: 144 - DNA, 50 bp, Homo sapiens
agagagacttctcattggctgtgaaggtagagcttttggggaaattcctg

SEQ ID NO: 145 - DNA, 50 bp, Homo sapiens
caggaatttccccaaaagctctaccttcacagccaatgagaagtctctct

SEQ ID NO: 146 - DNA, 50 bp, Homo sapiens; identical to SEQ ID NO: 144

SEQ ID NO: 147 - DNA, 50 bp, Homo sapiens
catctcagccctgcctttctctggagcattctgaaaacagatattctggc

SEQ ID NO: 148 - DNA, 50 bp, Homo sapiens
tcatgataacctgcagacctgatcaagcctctgtgcctcagtttctctct

SEQ ID NO: 149 - DNA, 50 bp, Homo sapiens
atgggggtaataagagcagtagcagcagcatctctgaacatttctctgga

SEQ ID NO: 150 - DNA, 50 bp, Homo sapiens
gaaattgcttttcctcttgaaccacagttctacccctgggatgttttgag

SEQ ID NO: 151 - DNA, 50 bp, Homo sapiens
aattcctcaggaagtaaaaccgaagaagatggcccagctccccaagaaag

SEQ ID NO: 152 - DNA, 50 bp, Homo sapiens
aacatccaaggagaaacagagacaggcccaagagatgaagagtgagaggg

SEQ ID NO: 153 - DNA, 50 bp, Homo sapiens
tcgtgtgaatcagactaagtgggatttcatttttacaactctgctctact

SEQ ID NO: 154 - DNA, 50 bp, Homo sapiens
gcatatacaagttggaagactaaagaggtgcaatgtgatctgagcctcca

SEQ ID NO: 155 - DNA, 50 bp, Homo sapiens
tgagtgtgtttgtgtgcatgaaagagaaagactgattacctcctgtgtgg

SEQ ID NO: 156 - DNA, 50 bp, Homo sapiens
agctgttcccaaattttctaacgagtggaccattatcactttaaagccct

SEQ ID NO: 157 - DNA, 50 bp, Homo sapiens
atcaacagaccaacatttttctcttcctcaagcaacactcctagggcctg

SEQ ID NO: 158 - DNA, 50 bp, Homo sapiens
tatgactgatgatcctccaacaacaaaaccacttactgctcgtaaattca

SEQ ID NO: 159 - DNA, 50 bp, Homo sapiens
aaaatactgatgttcctagtgaaagaggcagcttgaaactgagatgtgaa

SEQ ID NO: 160 - DNA, 50 bp, Homo sapiens
ggaagactttaaaccacctagttctcccactggggcatcggtctaaagct

SEQ ID NO: 161 - DNA, 50 bp, Homo sapiens
ccctgttccacaaacccatatgtatcctttcctcaacctcctcctttccc

SEQ ID NO: 162 - DNA, 50 bp, Homo sapiens
gtgtgtgagtgtgagtgtgagcgagagggtgagtgtggtcagagtaaagc

SEQ ID NO: 163 - DNA, 50 bp, Homo sapiens
tctggtcattcaaggatcccctcccaaggctatgcttttctataactttt

SEQ ID NO: 164 - DNA, 50 bp, Homo sapiens
ggcagctcaggaccactccaatgacccacctaacaagatgaatgaagtta

SEQ ID NO: 165 - DNA, 50 bp, Homo sapiens
tgttcttcatctaagccttctggttttatgggtcagagttccgactgcca

SEQ ID NO: 166 - DNA, 50 bp, Homo sapiens
gccttcatgcacctgtcctttctaacacgtcgccttcaactgtaatcaca

SEQ ID NO: 167 - DNA, 50 bp, Homo sapiens
ccctctcctctcttcctccctggaatcttgtaaaggtcctggcaaagatg

SEQ ID NO: 168 - DNA, 50 bp, Homo sapiens
ctgggctgggacgtgacctgtgctgagggctgtgagaatgtgaaacaaca

SEQ ID NO: 169 - DNA, 50 bp, Homo sapiens
gggatgaacgaaagccccctcttcaactcctctcactttttaaagcattg

SEQ ID NO: 170 - DNA, 50 bp, Homo sapiens
acaatgttgagttcagcatgtgtctgccatttcatttgtacgcttgttca

SEQ ID NO: 171 - DNA, 50 bp, Homo sapiens
tttcagtcccagaacctacagataccctgctacttgcttcacgtggatgc

SEQ ID NO: 172 - DNA, 50 bp, Homo sapiens
aattcagttagctccattcagaaccaaatgcagtccaagggaggttatgg

SEQ ID NO: 173 - DNA, 50 bp, Homo sapiens
cccatcttacagaagttgaggccaagggagaatggtaggcacagaagaaa

SEQ ID NO: 174 - DNA, 50 bp, Homo sapiens
tgtgttaagtgcaggagacattggtattctgggcaccttcctaatatgct

SEQ ID NO: 175 - DNA, 50 bp, Homo sapiens
tgtgttaagtgcaggagacattggtattctgggcagcttcctaatatgct

SEQ ID NO: 176 - DNA, 50 bp, Homo sapiens
agctgtgttggtagtgctgtgttgaattacggaataatgagttagaacta

SEQ ID NO: 177 - DNA, 50 bp, Homo sapiens; identical to SEQ ID NO: 115

SEQ ID NO: 178 - DNA, 60 bp, Homo sapiens
tgcatgttggggtttcctttaccttttctataagttgtaccaaaacatccacttaagttc

SEQ ID NO: 179 - DNA, 70 bp, Homo sapiens
tgttggggtttcctttaccttttctataagttgtaccaaaacatccacttaagttctttgatttgtacca

SEQ ID NO: 180 - DNA, 50 bp, Homo sapiens
tctacctgcagtctccattgtttccagagtgaacttgtaattatcttgtt

SEQ ID NO: 181 - DNA, 50 bp, Homo sapiens
gtgtgcgtgtgtgtgtgcctgtccagtgtatattgtgtcttagcttccat

SEQ ID NO: 182 - DNA, 50 bp, Homo sapiens
ctgaagggaagagagccttgaatagactgaagcgaagacggttctgcaag

SEQ ID NO: 183 - DNA, 50 bp, Homo sapiens
ttctctgcatctaggccatcatactgccaggctggttatgactcagaaga

SEQ ID NO: 184 - DNA, 50 bp, Homo sapiens
cttcctgtacctcctccccacagcttgcttttgttgtaccgtctttcaat

SEQ ID NO: 185 - DNA, 50 bp, Homo sapiens
aacctgcacaagcatgtaataaaagagcacacttaaaaacattctgacca

SEQ ID NO: 186 - DNA, 50 bp, Homo sapiens
tggtcagaatgtttttaagtgtgctcttttattacatgcttgtgcaggtt

SEQ ID NO: 187 - DNA, 50 bp, Homo sapiens
ccttctgaaggtgtatagatacagcttgtcttgaaatgtctttctccaca

SEQ ID NO: 188 - DNA, 50 bp, Homo sapiens
tgtggagaaagacatttcaagacaagctgtatctatacaccttcagaagg

SEQ ID NO: 189 - DNA, 50 bp, Homo sapiens
tgctaggtcacagaggatctgcttggtcttgataagctatgttgttgcac

SEQ ID NO: 190 - DNA, 50 bp, Homo sapiens
ctagaggaccattcatgcaatgactatttctaaagcacctgctacacagc

SEQ ID NO: 191 - DNA, 50 bp, Homo sapiens
gggagtttctgagggtctgctttgtttacctttcgtgcggtggattcttt

SEQ ID NO: 192 - DNA, 50 bp, Homo sapiens
tcggaggagtcggacgaggatatgggatttggtctctttgactaatcacc

SEQ ID NO: 193 - DNA, 50 bp, Homo sapiens
ttccttcctcggtggtgttaatcatttcgtttttaccctttaccttcgga

SEQ ID NO: 194 - DNA, 50 bp, Homo sapiens
gtctacatcaactattacgacatgaacgcggccaatgtgggctggaacaa

SEQ ID NO: 195 - DNA, 50 bp, Homo sapiens
cagaagggtcaaaaagctccagcccagaaagcacctgctccaaaggcatc

SEQ ID NO: 196 - DNA, 50 bp, Homo sapiens
gaccttcctgccaccagtcactgtccctcaaatgacccaaagaccaatat

SEQ ID NO: 197 - DNA, 50 bp, Homo sapiens
gagatggggagggctaccacagagttatccactttacaacggagacacag

SEQ ID NO: 198 - DNA, 50 bp, Homo sapiens
atgggtttggcttgaggctggtagcttctatgtaattcgcaatgattcca

SEQ ID NO: 199 - DNA, 50 bp, Homo sapiens
catccctccatgtactctgggtatcagcaactgtcctcatcagtctccat

SEQ ID NO: 200 - DNA, 50 bp, Homo sapiens
accttacaggagatcatcaaaactttgaacagcctcacagagcagaagac

SEQ ID NO: 201 - DNA, 50 bp, Homo sapiens
gagaagacagtggcgaccaagacgattttctgccttagagcaagggattc

SEQ ID NO: 202 - DNA, 50 bp, Homo sapiens
caggggatcagtgaaggaagagaaggccagcagatcagtgagagtgcaac

SEQ ID NO: 203 - DNA, 50 bp, Homo sapiens
cccattccctctctactcttgacagcaggattggatgttgtgtattgtgg

SEQ ID NO: 204 - DNA, 50 bp, Homo sapiens
acttaatatgtgggaaacccttttgcgtggtccttaggcttacaatgtgc

SEQ ID NO: 205 - DNA, 50 bp, Homo sapiens
aaaatacaagggctgttggtgagagcagacttgaggtgatgatagttggc

SEQ ID NO: 206 - DNA, 50 bp, Homo sapiens
ccagattttccccaaacttgcttctgttgagatttttccctcaccttgcc

SEQ ID NO: 207 - DNA, 50 bp, Homo sapiens
accttgggttgagtaatgctcgtctgtgtgttttagtttcatcacctgtt

SEQ ID NO: 208 - DNA, 50 bp, Homo sapiens
aaactcccctttcttgaggttgtctgagtcttgggtctatgccttgaaaa

SEQ ID NO: 209 - DNA, 50 bp, Homo sapiens
ctcagtgttggtgtggtgatgtttgttgcttttatgatttcatattgtgc

SEQ ID NO: 210 - DNA, 50 bp, Homo sapiens
ctgtatctttgacaattctgggtgcgagtgtgagagtgtgagcagggctt

SEQ ID NO: 211 - DNA, 50 bp, Homo sapiens
gataagtgtcctatggggatggtccactgtcactgtttctctgctgttgc

SEQ ID NO: 212 - DNA, 60 bp, Homo sapiens
tttagccaaaggataagtgtcctatggggatggtccactgtcactgtttctctgctgttg

SEQ ID NO: 213 - DNA, 70 bp, Homo sapiens
atttatattagtttagccaaaggataagtgtcctatggggatggtccactgtcactgtttctctgctgtt

SEQ ID NO: 214 - DNA, 50 bp, Homo sapiens
gaaggaagaagtggggtggaagaagtggggtgggacgacagtgaaatcta

SEQ ID NO: 215 - DNA, 50 bp, Homo sapiens
ccatcaatgaggtatcttctttagtggtggtatgtaatggaacttagcca

SEQ ID NO: 216 - DNA, 50 bp, Homo sapiens
aaagacgtgcactcaaccttctaccaggccactctcaggctcaccttaaa

SEQ ID NO: 217 - DNA, 50 bp, Homo sapiens
ccaagctgcttgtcctgggcctgcccctgtgtattcaccaccaataaatc

SEQ ID NO: 218 - DNA, 50 bp, Homo sapiens
cactggggacgagacaggtgctaaagttgaacgagctgatggatatgaac

SEQ ID NO: 219 - DNA, 50 bp, Homo sapiens
cgttgctgaagtggtaattgaggaaaacagttccccagattgttaagagt

SEQ ID NO: 220 - DNA, 50 bp, Homo sapiens
ctccccgtgagcactgcgtacaaacatccaaaagttcaacaacaccagaa

SEQ ID NO: 221 - DNA, 50 bp, Homo sapiens
agtgcctttcaggatctatttttggaggtttattacgtatgtctggttct

SEQ ID NO: 222 - DNA, 50 bp, Homo sapiens
agaacaaactaagccaggtatgcaaatatcgctgaatagaaacagatgga

SEQ ID NO: 223 - DNA, 50 bp, Homo sapiens; identical to SEQ ID NO: 222

SEQ ID NO: 224 - DNA, 50 bp, Homo sapiens
gcaattcctcaggctaagctgccggttcttaaatccatcctgctaagtta

SEQ ID NO: 225 - DNA, 50 bp, Homo sapiens
tcctggtggctctttgtggaggaaactaaacattcccttgatggtctcaa

SEQ ID NO: 226 - DNA, 50 bp, Homo sapiens
ctttgggttggagctgttccattgggtcctcttggtgtcgtttccctccc

SEQ ID NO: 227 - DNA, 50 bp, Homo sapiens
agaaaaagcttgggttaactcagtagttagatcaaagcaaatgtggactg

SEQ ID NO: 228 - DNA, 50 bp, Homo sapiens
acagatgtagcaacatgagaaacgcttatgttacaggttacatgagagca

SEQ ID NO: 229 - DNA, 50 bp, Homo sapiens
tgtttaatggtagttttacagtgtttctggcttagaacaaaggggcttaa

SEQ ID NO: 230 - DNA, 50 bp, Homo sapiens
tgccagcatatactgaagtcttttctgtcaccaaatttgtacctctaagt

SEQ ID NO: 231 - DNA, 50 bp, Homo sapiens
gctgcatatgagtaaagttaccccaaccacagtgaggaggaagatgttca

SEQ ID NO: 232 - DNA, 50 bp, Homo sapiens
aaacctccagtactttggttgacccttgtatgtcacagctctgctctatt

SEQ ID NO: 233 - DNA, 50 bp, Homo sapiens
acctgatcaatgacagagccttctgaggacattccaagacagtatacagt

SEQ ID NO: 234 - DNA, 50 bp, Homo sapiens
gcccttcccttcttggtttccaaaggcatttattgctgagttatatgttc

SEQ ID NO: 235 - DNA, 50 bp, Homo sapiens
ctgattgtagcagcctcgttagtgtcaccccctcctccctgatctgtcag

SEQ ID NO: 236 - DNA, 50 bp, Homo sapiens
accaaaaagaatagggaaaaacaagaatttcatgactctacctgtggtct

SEQ ID NO: 237 - DNA, 50 bp, Homo sapiens
gacttttccaaccctcatcaccaacgtctgtgccattttgtattttacta

SEQ ID NO: 238 - DNA, 50 bp, Homo sapiens
gctcgctaccagaaatcctaccgataagcccatcgtgactcaaaactcac

SEQ ID NO: 239 - DNA, 50 bp, Homo sapiens
acctgagtcccacaacaattgaaactgcaatgaagtctccttattctgct

SEQ ID NO: 240 - DNA, 50 bp, Homo sapiens
aattgatgaggatgctcctgggagggatgcgtgactatgtggtgttgcac

SEQ ID NO: 241 - DNA, 50 bp, Homo sapiens
tgaaatatgggaaagttgctgctattgattcagggtctgtcttggaggca

SEQ ID NO: 242 - DNA, 50 bp, Homo sapiens
caactgatagccacgctgaagaatggaaggaaaatttgcttggacctgca

SEQ ID NO: 243 - DNA, 50 bp, Homo sapiens
tgtgtaaatacataagcggcgtaagtttaaaggatgttggtgttccacgt

SEQ ID NO: 244 - DNA, 50 bp, Homo sapiens
aaccctcctccaatggaaattcccgtgttgcttcaaactgagacagatgg

SEQ ID NO: 245 - DNA, 60 bp, Homo sapiens
cctccaatggaaattcccgtgttgcttcaaactgagacagatgggacttaacaggcaatg

SEQ ID NO: 246 - DNA, 70 bp, Homo sapiens
ccaaccctcctccaatggaaattcccgtgttgcttcaaactgagacagatgggacttaacaggcaatggg

SEQ ID NO: 247 - DNA, 50 bp, Homo sapiens
aatcatcatctggatttaggaattgctcttgtcatacccccaagtttcta

SEQ ID NO: 248 - DNA, 50 bp, Homo sapiens
gcaagacatagaatagtgttggaaaatgtgcaatatgtgatgtggcaaat

SEQ ID NO: 249 - DNA, 50 bp, Homo sapiens
tctccatcttggtataaatacacttccacagtcagcacggggatcacaga

SEQ ID NO: 250 - DNA, 50 bp, Homo sapiens
tctccttactgggatagtcaggtaaacagttggtcaagactttgtaaaga

SEQ ID NO: 251 - DNA, 50 bp, Homo sapiens
acccatgatgagctcctcttcctggcttcttactgaaaggttaccctgta

SEQ ID NO: 252 - DNA, 50 bp, Homo sapiens
tgacatcatattctttcagagaagtgtcccaggacatgataataagatgc

SEQ ID NO: 253 - DNA, 50 bp, Homo sapiens
atcagaaaccgaagattaactacacagctccagaagactcagacctcaaa

SEQ ID NO: 254 - DNA, 50 bp, Homo sapiens
caggttcttaagggattctccgttttggttccattttgtacacgtttgga

SEQ ID NO: 255 - DNA, 50 bp, Homo sapiens
ctagaagatccacatcctctacaggtcggggaccaaaggctgattcttgg

SEQ ID NO: 256 - DNA, 50 bp, Homo sapiens
cttcttttgccatgtttccattctgccatcttgaattgtcttgtcagcca

SEQ ID NO: 257 - DNA, 50 bp, Homo sapiens
catggagacttgaggagggcttgaggttggtgaggttaggtgcgtgtttc

SEQ ID NO: 258 - DNA, 50 bp, Homo sapiens
cccatgtaagcaccccttcatttggcattccccacttgagaattaccctt

SEQ ID NO: 259 - DNA, 50 bp, Homo sapiens
cttgggccagactgtcagggttcaaggagggcatcaggagcagacggaga

SEQ ID NO: 260 - DNA, 50 bp, Homo sapiens
cctccgctcaactagcagatacagggatgaggcagacctgactctcttaa

SEQ ID NO: 261 - DNA, 50 bp, Homo sapiens
cagcggaacccttagcacccacatggaccaacagttcttccaaacttgac

SEQ ID NO: 262 - DNA, 50 bp, Homo sapiens
atgcctggtgcttccaaatattgttgacaactgtgactgtacccaaatgg

SEQ ID NO: 263 - DNA, 50 bp, Homo sapiens
cctctctccaaacccgttttccaacatttgttaatagttacgtctctcct

SEQ ID NO: 264 - DNA, 50 bp, Homo sapiens
tcatttgttgtgtgactgagtaaagaatttttggatcaagcggaaagagt

SEQ ID NO: 265 - DNA, 50 bp, Homo sapiens
tgaggatgtagagagaacaggtgggctgtattcacgccattggttggaag

SEQ ID NO: 266 - DNA, 50 bp, Homo sapiens
gaaattaaatgggttccaggtcttaaagaaagtgcagaagagatggtcaa

SEQ ID NO: 267 - DNA, 50 bp, Homo sapiens
aaccactatcatctacggcacaaacttgcaaaagctgtccacaccatttt

SEQ ID NO: 268 - DNA, 50 bp, Homo sapiens
cccgttttggggacgtgaacgttttaataatttttgctgaattctttaca

SEQ ID NO: 269 - DNA, 50 bp, Homo sapiens
tcagttttcaggagtgggttgatttcagcacctacagtgtacagtcttgt

SEQ ID NO: 270 - DNA, 50 bp, Homo sapiens
agcctatctgcttaagagactctggagtttcttatgtgccctggtggaca

SEQ ID NO: 271 - DNA, 50 bp, Homo sapiens
gagtagaaggacaacagggcagcaacttggagggagttctctggggatgg

SEQ ID NO: 272 - DNA, 50 bp, Homo sapiens
gttctggaactaaagggatctgaaacaacattcatgtgtgaatatgcaga

SEQ ID NO: 273 - DNA, 60 bp, Homo sapiens
tggaactaaagggatctgaaacaacattcatgtgtgaatatgcagatgagacagcaacca

SEQ ID NO: 274 - DNA, 70 bp, Homo sapiens
cagggacttaatcagcaatatcaacgtaatagttctggaactaaagggatctgaaacaacattcatgtgt

SEQ ID NO: 275 - DNA, 50 bp, Homo sapiens
acccattccatttatctttctacagggctgacattgtggcacattcttag

SEQ ID NO: 276 - DNA, 50 bp, Homo sapiens
tgaacctccaacagggaaggctctgtccagaaaggattgaatgtgaaacg

SEQ ID NO: 277 - DNA, 50 bp, Homo sapiens
tgaaggagatgatgagaatcttattccagggaccaacattaacacaacca

SEQ ID NO: 278 - DNA, 50 bp, Homo sapiens
ctctctggaggtactgagacagggtgctgatgggaaggaggggagccttt

SEQ ID NO: 279 - DNA, 50 bp, Homo sapiens
ctcttcggcaaatgtagcatgggcacctcagattgttgttgttaatgggc

SEQ ID NO: 280 - DNA, 50 bp, Homo sapiens
ttccagaaagaaaagatgagagggatgagaggcaagatatgaagatgaaa

SEQ ID NO: 281 - DNA, 50 bp, Homo sapiens
ggccagcctggacccaatcatgaggaagatgcagactcttatgagaacat

SEQ ID NO: 282 - DNA, 50 bp, Homo sapiens
aatgtttgcccagaataaagaaaataagctttgcacacactctcaattct

SEQ ID NO: 283 - DNA, 50 bp, Homo sapiens
gggaaagaaataccaaccctgcaataagtgtactaaactctacgctctgg

SEQ ID NO: 284 - DNA, 50 bp, Homo sapiens
caccagcgccttggctttgtgttagcatttcctcctgaagtgttctgttg

SEQ ID NO: 285 - DNA, 50 bp, Homo sapiens
acatcgtgattctccagctcaacgggtcggccaccatcaacgccaacgtg

SEQ ID NO: 286 - DNA, 50 bp, Homo sapiens
agctacgtatccatcgtgatggcatctacatggtacacatccaggtgacg

SEQ ID NO: 287 - DNA, 50 bp, Homo sapiens
ccacactgaatctcccctcctcacagttgccatgtagaccccttgaagag

SEQ ID NO: 288 - DNA, 60 bp, Homo sapiens
cagtcccccaccacactgaatctcccctcctcacagttgccatgtagaccccttgaagag

SEQ ID NO: 289 - DNA, 70 bp, Homo sapiens
ccatgtagaccccttgaagaggggaggggcctagggagccgcaccttgtcatgtaccatcaataaagtac

SEQ ID NO: 290 - DNA, 50 bp, Homo sapiens
ctcttcaaggggtctacatggcaactgtgaggaggggagattcagtgtgg

SEQ ID NO: 291 - DNA, 60 bp, Homo sapiens
ctcttcaaggggtctacatggcaactgtgaggaggggagattcagtgtggtgggggactg

SEQ ID NO: 292 - DNA, 70 bp, Homo sapiens
gtactttattgatggtacatgacaaggtgcggctccctaggcccctcccctcttcaaggggtctacatgg

SEQ ID NO: 293 - DNA, 50 bp, Homo sapiens
tttccttgttccctcccatgcctagctggattgcagagttaagtttatga

SEQ ID NO: 294 - DNA, 60 bp, Homo sapiens
tttccttgttccctcccatgcctagctggattgcagagttaagtttatgattatgaaata

SEQ ID NO: 295 - DNA, 70 bp, Homo sapiens
gttccatgttttccttgttccctcccatgcctagctggattgcagagttaagtttatgattatgaaataa

SEQ ID NO: 296 - DNA, 50 bp, Homo sapiens
tcataaacttaactctgcaatccagctaggcatgggagggaacaaggaaa

SEQ ID NO: 297 - DNA, 60 bp, Homo sapiens
tatttcataatcataaacttaactctgcaatccagctaggcatgggagggaacaaggaaa

SEQ ID NO: 298 - DNA, 70 bp, Homo sapiens
ttatttcataatcataaacttaactctgcaatccagctaggcatgggagggaacaaggaaaacatggaac

SEQ ID NO: 299 - DNA, 50 bp, Homo sapiens
gtcatccacctggccctcaaggagagaggcgggaggaagaagtagacaag

SEQ ID NO: 300 - DNA, 50 bp, Homo sapiens
tgactgaggaggagaagaatatcaaatggggttgagtgtgcagatctctg

SEQ ID NO: 301 - DNA, 50 bp, Homo sapiens
tggttttccaaaatgcacactgcgggttattgatttgttctttacaacta

SEQ ID NO: 302 - DNA, 50 bp, Homo sapiens
actgtcagcatgttgttgttgaagtgtggagttgtaactctgcgtggact

SEQ ID NO: 303 - DNA, 50 bp, Homo sapiens
tgagtcacatcctgggatccagtgtataaatccaatatcatgtcttgtgc

SEQ ID NO: 304 - DNA, 50 bp, Homo sapiens
gttctgctactgcgaattgatgacatcgtttcaggccacaaaaagaaagg

SEQ ID NO: 305 - DNA, 50 bp, Homo sapiens
acattcccttggatgtagtctgaggccccttaactcatctgttatcctgc

SEQ ID NO: 306 - DNA, 50 bp, Homo sapiens
actggcttccatcagtggtaactgctttggtctcttctttcatctgggga

SEQ ID NO: 307 - DNA, 50 bp, Arabidopsis thaliana
ccattggagaacttggcaactcacttggcggatccatggcacaacaacat

SEQ ID NO: 308 - DNA, 50 bp, Arabidopsis thaliana
ttttctcctttgtgtaattgtggattggatcttgtcctcttttgttccct

SEQ ID NO: 309 - DNA, 50 bp, Arabidopsis thaliana
tattctttcgtgtcagggcttgaaccaagtatccccgcttcttctacccc

SEQ ID NO: 310 - DNA, 50 bp, Arabidopsis thaliana
catcaagtgaagtggggaataacgacatcatttgcctgaagagtatggtt

SEQ ID NO: 311 - DNA, 50 bp, Arabidopsis thaliana
aatgagggcattggtttgctagttgctaattgatcagtgatgtattgtca

SEQ ID NO: 312 - DNA, 50 bp, Arabidopsis thaliana
tggaatcaacaagatggcttctttccccaccaaaactaagtgatcatcag

SEQ ID NO: 313 - DNA, 50 bp, Arabidopsis thaliana
tggaccgtaatgaatgaatgtacacgccataaacgccctttgttcaagca

SEQ ID NO: 314 - DNA, 50 bp, Arabidopsis thaliana
cctcactcttgtacccacggtagattcatgtaaaataccacttatgacgc

SEQ ID NO: 315 - DNA, 50 bp, Arabidopsis thaliana
ggttagcgaccttgttgttgttgttgtgttcttacatcttcttcttgaac

SEQ ID NO: 316 - DNA, 50 bp, Arabidopsis thaliana
ggcgaaaaggacggtcttgcttgtttgtaatttgtgtggagataaaaaga

SEQ ID NO: 317 - DNA, 50 bp, Homo sapiens; identical to SEQ ID NO: 128

SEQ ID NO: 318 - DNA, 50 bp, Homo sapiens
tgaaatatcagactagtgacaagctcctggtcttgagatgtcttctcgtt

SEQ ID NO: 319 - DNA, 60 bp, Homo sapiens
ggttgagttacttcctatcaagccagtaccgtgctaacaggctcaatattcctgaatgaa

SEQ ID NO: 320 - DNA, 70 bp, Homo sapiens
gttgagttacttcctatcaagccagtaccgtgctaacaggctcaatattcctgaatgaaatatcagacta

SEQ ID NO: 321 - DNA, 50 bp, Homo sapiens
aacgagaagacatctcaagaccaggagcttgtcactagtctgatatttca

SEQ ID NO: 322 - DNA, 60 bp, Homo sapiens
ttcattcaggaatattgagcctgttagcacggtactggcttgataggaagtaactcaacc

SEQ ID NO: 323 - DNA, 70 bp, Homo sapiens
tagtctgatatttcattcaggaatattgagcctgttagcacggtactggcttgataggaagtaactcaac

SEQ ID NO: 324 - DNA, 50 bp, Homo sapiens
tttcaagacagaaagtgacgcagagaacctccccggcccagtctcgacgc

SEQ ID NO: 325 - DNA, 50 bp, Homo sapiens
gcgtcgagactgggccggggaggttctctgcgtcactttctgtcttgaaa

SEQ ID NO: 326 - DNA, 50 bp, Homo sapiens
cctagacacctgcatcagtcaaggtcatggatattgggaagacagacagc

SEQ ID NO: 327 - DNA, 50 bp, Homo sapiens
gctgtctgtcttcccaatatccatgaccttgactgatgcaggtgtctagg

SEQ ID NO: 328 - DNA, 50 bp, Homo sapiens
aaataagaagaggaaagagagaggcctgccctaacccactgttgtgctga

SEQ ID NO: 329 - DNA, 50 bp, Homo sapiens
tcagcacaacagtgggttagggcaggcctctctctttcctcttcttattt

SEQ ID NO: 330 - DNA, 50 bp, Homo sapiens
ctcatgcctgcagtgctgctcatgttgcccccttggaattacttgttcaa

SEQ ID NO: 331 - DNA, 50 bp, Homo sapiens
ttgaacaagtaattccaagggggcaacatgagcagcactgcaggcatgag

SEQ ID NO: 332 - DNA, 50 bp, Homo sapiens
ccaatttctataattattgaacagcttttcgtggggccagcacaaagtct

SEQ ID NO: 333 - DNA, 50 bp, Homo sapiens
agactttgtgctggccccacgaaaagctgttcaataattatagaaattgg

SEQ ID NO: 334 - DNA, 50 bp, Homo sapiens
tggctacaaatagagtagagaacagactccagtcctcaaagactttcagt

SEQ ID NO: 335 - DNA, 50 bp, Homo sapiens
actgaaagtctttgaggactggagtctgttctctactctatttgtagcca

SEQ ID NO: 336 - DNA, 50 bp, Homo sapiens
agttaagatggaagaatatagagaccttctgaagagcactgtagcttgga

SEQ ID NO: 337 - DNA, 50 bp, Homo sapiens
tccaagctacagtgctcttcagaaggtctctatattcttccatcttaact

SEQ ID NO: 338 - DNA, 50 bp, Homo sapiens
cactcctatggcatgtggaagcaggtctgagcagtgtgcatagaagaaaa

SEQ ID NO: 339 - DNA, 50 bp, Homo sapiens
ttttcttctatgcacactgctcagacctgcttccacatgccataggagtg

SEQ ID NO: 340 - DNA, 50 bp, Homo sapiens
gctctccgttgacaatggccaaagaatagaagctctagaccttccttatt

SEQ ID NO: 341 - DNA, 50 bp, Homo sapiens
aataaggaaggtctagagcttctattctttggccattgtcaacggagagc

SEQ ID NO: 342 - DNA, 50 bp, Homo sapiens
ggcaaaacgcacctggcacaacagaacgaataatacagaagctggatgac

SEQ ID NO: 343 - DNA, 50 bp, Homo sapiens
gtcatccagcttctgtattattcgttctgttgtgccaggtgcgttttgcc

SEQ ID NO: 344 - DNA, 50 bp, Homo sapiens
tagccatttcttcctgattgtgcctagtatatcccagacagtttgtttct

SEQ ID NO: 345 - DNA, 50 bp, Homo sapiens
agaaacaaactgtctgggatatactaggcacaatcaggaagaaatggcta

SEQ ID NO: 346 - DNA, 50 bp, Homo sapiens
ggttggaatggtgatcgggatgcagtgagatactcttgtgagagggcaaa

SEQ ID NO: 347 - DNA, 50 bp, Homo sapiens
tttgccctctcacaagagtatctcactgcatcccgatcaccattccaacc

SEQ ID NO: 348 - DNA, 50 bp, Homo sapiens
gccatgagattcaacagtcaacatcagtctgataagctacccgacaaagt

SEQ ID NO: 349 - DNA, 50 bp, Homo sapiens
actttgtcgggtagcttatcagactgatgttgactgttgaatctcatggc

SEQ ID NO: 350 - DNA, 50 bp, Homo sapiens
aagaggacaagtttgagaggcaacacttaaacactagggctactgtggca

SEQ ID NO: 351 - DNA, 50 bp, Homo sapiens
tgccacagtagccctagtgtttaagtgttgcctctcaaacttgtcctctt

SEQ ID NO: 352 - DNA, 50 bp, Homo sapiens
atttgctttaaattgagtttccttgccattgcacactcctatctttctga

SEQ ID NO: 353 - DNA, 50 bp, Homo sapiens
tcagaaagataggagtgtgcaatggcaaggaaactcaatttaaagcaaat

SEQ ID NO: 354 - DNA, 50 bp, Homo sapiens
aaaagtcactaccaggctggcagggaatggggcaatctattcatactgat

SEQ ID NO: 355 - DNA, 50 bp, Homo sapiens
atcagtatgaatagattgccccattccctgccagcctggtagtgactttt

SEQ ID NO: 356 - DNA, 50 bp, Homo sapiens
atattgatttggatacggtgaataagctggacaagatgttgaggagaggg

SEQ ID NO: 357 - DNA, 50 bp, Homo sapiens
ccctctcctcaacatcttgtccagcttattcaccgtatccaaatcaatat

SEQ ID NO: 358 - DNA, 50 bp, Homo sapiens
aatgtgcaaggtgaaatgcttttggataaacgtaagcctattttctgacg

SEQ ID NO: 359 - DNA, 50 bp, Homo sapiens
cgtcagaaaataggcttacgtttatccaaaagcatttcaccttgcacatt

SEQ ID NO: 360 - DNA, 50 bp, Homo sapiens
ttcatctctaaggcacacttgctacccctctttgctgaccccagattgtg

SEQ ID NO: 361 - DNA, 50 bp, Homo sapiens
cacaatctggggtcagcaaagaggggtagcaagtgtgccttagagatgaa

SEQ ID NO: 362 - DNA, 50 bp, Homo sapiens
ttctggcaagctcttgtcatggtgttcgacacttccttctgtcttcttgg

SEQ ID NO: 363 - DNA, 50 bp, Homo sapiens
ccaagaagacagaaggaagtgtcgaacaccatgacaagagcttgccagaa

SEQ ID NO: 364 - DNA, 50 bp, Homo sapiens
ggtcaatgtagccaattatttgtttcaacagttgcagaacagatatttca

SEQ ID NO: 365 - DNA, 50 bp, Homo sapiens
tgaaatatctgttctgcaactgttgaaacaaataattggctacattgacc

SEQ ID NO: 366 - DNA, 50 bp, Homo sapiens
tgaaaagacagctaatttggtccaacaaacatgactgggtctagggcacc

SEQ ID NO: 367 - DNA, 50 bp, Homo sapiens
ggtgccctagacccagtcatgtttgttggaccaaattagctgtcttttca

SEQ ID NO: 368 - DNA, 50 bp, Homo sapiens
tggatcattgcccaaagttgcacgcactgactccttacctgtgaggaatg

SEQ ID NO: 369 - DNA, 50 bp, Homo sapiens
cattcctcacaggtaaggagtcagtgcgtgcaactttgggcaatgatcca

SEQ ID NO: 370 - DNA, 50 bp, Homo sapiens
ttaaaacattaaaagattgactccactttgtgccaagctctgcgggtagg

SEQ ID NO: 371 - DNA, 50 bp, Homo sapiens
cctacccgcagagcttggcacaaagtggagtcaatcttttaatgttttaa

SEQ ID NO: 372 - DNA, 50 bp, Homo sapiens
tgaatttggagtccctggcacataaatctaccttcaaatcagaggtcctt

SEQ ID NO: 373 - DNA, 50 bp, Homo sapiens
aaggacctctgatttgaaggtagatttatgtgccagggactccaaattca

SEQ ID NO: 374 - DNA, 50 bp, Homo sapiens
tgggtcagagacgaaaagggctattattaggtcaaacattacagaaatca

SEQ ID NO: 375 - DNA, 50 bp, Homo sapiens
tgatttctgtaatgtttgacctaataatagcccttttcgtctctgaccca

SEQ ID NO: 376 - DNA, 50 bp, Homo sapiens
ctgatttaacaggtggttctgcgggcgtccaggtcaacatctttttgtcc

SEQ ID NO: 377 - DNA, 50 bp, Homo sapiens
ggacaaaaagatgttgacctggacgcccgcagaaccacctgttaaatcag

SEQ ID NO: 378 - DNA, 50 bp, Homo sapiens
gtcactttagcgagcgggaaaacaatggcggaaagggaaaacctggaaag

SEQ ID NO: 379 - DNA, 50 bp, Homo sapiens
ctttccaggttttccctttccgccattgttttcccgctcgctaaagtgac

SEQ ID NO: 380 - DNA, 50 bp, Homo sapiens
taattaatagagctcacttaagattgcccatcaagaaacaggagggtggt

SEQ ID NO: 381 - DNA, 50 bp, Homo sapiens
accaccctcctgtttcttgatgggcaatcttaagtgagctctattaatta

SEQ ID NO: 382 - DNA, 50 bp, Homo sapiens
agtcctgctgaatcattggtttatagaagactatctggagggcctgatag

SEQ ID NO: 383 - DNA, 50 bp, Homo sapiens
ctatcaggccctccagatagtcttctataaaccaatgattcagcaggact

SEQ ID NO: 384 - DNA, 50 bp, Homo sapiens
atgtgattccatgataatcaaatagtgaatacattataaagtcagcaact

SEQ ID NO: 385 - DNA, 50 bp, Homo sapiens
atatatgggggctgggcctcgggactctcgctctaataaaggactgtagg

SEQ ID NO: 386 - DNA, 50 bp, Homo sapiens
ttttgacccagatgatggttcctttacagaacaataaaatggctgaacat

SEQ ID NO: 387 - DNA, 50 bp, Homo sapiens
tgagcactggaaacagtttcatggagtttaagttgagtgaacatcggcca

SEQ ID NO: 388 - DNA, 50 bp, Homo sapiens
atgcatttagtttttggcaccgtagtttaagggtgggattgccagttttt

SEQ ID NO: 389 - DNA, 50 bp, Homo sapiens
ggttgtgtctctggtttccccttttccccgtggttttaatttttaagaac

SEQ ID NO: 390 - DNA, 50 bp, Homo sapiens
ggaggacacccctgtgtgttgctgctgccttccgtgctgtctactgtatc

SEQ ID NO: 391 - DNA, 50 bp, Homo sapiens
gcatcagagagaatatggaaggacatcgaccctaacttcatccagtgagg

SEQ ID NO: 392 - DNA, 50 bp, Homo sapiens
accatagcagacagggtcagatggaatattagcggtttaggtgaagaacc

SEQ ID NO: 393 - DNA, 50 bp, Homo sapiens
agacagaagacaaggccaaatgggtgtctctggaatgatagacttagaaa

SEQ ID NO: 394 - DNA, 50 bp, Homo sapiens
atccacattcttacctttggtagtcaggtttggctactttgcagctcgcc

SEQ ID NO: 395 - DNA, 50 bp, Homo sapiens
atagcagtggattaccaacaccttgacttcttgtacagtgctaacatctt

SEQ ID NO: 396 - DNA, 50 bp, Homo sapiens
tagtaaaagtgaaagagaaagggtttttcctgccacaggatataactttt

SEQ ID NO: 397 - DNA, 50 bp, Homo sapiens
aaagcggtcgtttccccacaaggtgtccaactttgcggtactcacactta

SEQ ID NO: 398 - DNA, 50 bp, Homo sapiens
ctaggcccgcccaccccaaccttctggtggggagaaataaacggtttaga

SEQ ID NO: 399 - DNA, 50 bp, Homo sapiens
tgcactaaacagttgccccaaaagacatatcttgttttaaggcccagacc

SEQ ID NO: 400 - DNA, 50 bp, Homo sapiens
ttggatgaagctgaaaagacactaagaccttctgtgcctcagatccctga

SEQ ID NO: 401 - DNA, 50 bp, Homo sapiens
gtgtggcctaaggaacacctcttgtggggagtaagagccagcccttctcc

SEQ ID NO: 402 - DNA, 50 bp, Homo sapiens
aaggatgaaggactgatggagggcagaggaactggaggcagcaggcacaa

SEQ ID NO: 403 - DNA, 50 bp, Homo sapiens
agatgtctgtataaacaacctttgggtagcaggtggtcagttaggcagga

SEQ ID NO: 404 - DNA, 50 bp, Homo sapiens
tgcttgtcttttaaacaccttcacagatatcatttgcaccttgccaaagg

SEQ ID NO: 405 - DNA, 50 bp, Homo sapiens
gggtaggcagcttgcacccagttctcctttatctcaacttattttcctgg

SEQ ID NO: 406 - DNA, 50 bp, Homo sapiens
ccggtgtccctgagtgagggcaaagttgtaataacacttgttctctcctt

SEQ ID NO: 407 - DNA, 50 bp, Homo sapiens
acggcgttctgaaatttagcacactgggaagtccacatggttcatctgaa

SEQ ID NO: 408 - DNA, 50 bp, Homo sapiens
aatgagatcacagatggtgacactgagcggaaggatgcagtacctcggag

SEQ ID NO: 409 - DNA, 50 bp, Homo sapiens
tccttgcaaaacatttggctagtggtgttcagagaaataccaaaacgtgt

SEQ ID NO: 410 - DNA, 50 bp, Homo sapiens
ggcaaaggggaaggatgatgccatgtagatcctgtttgacatttttatgg

SEQ ID NO: 411 - DNA, 50 bp, Homo sapiens
actgttaaccaaattttgagcaaggagtctcaaaggtaattctgaaccag

SEQ ID NO: 412 - DNA, 50 bp, Homo sapiens
actagcagattgaatcgatattcattaagttaggaatggttggtggtcct

SEQ ID NO: 413 - DNA, 50 bp, Homo sapiens
aattgtgctttgtatcagtcagtgctggagaaatcttgaatagcttatgt

SEQ ID NO: 414 - DNA, 50 bp, Homo sapiens
aggaaaccaagccctcacaggaaagaaagcctgaatcaagaaaacaaagt

SEQ ID NO: 415 - DNA, 50 bp, Homo sapiens
actgagcaggacaactgacctgtctccttcacatagtccatatcaccaca

SEQ ID NO: 416 - DNA, 50 bp, Homo sapiens
gcgtaaaacgccagggccatcttcttacttaagccacatcctgaaccagg

SEQ ID NO: 417 - DNA, 50 bp, Homo sapiens
agcgacaagaaggaatctggtgaattttagtcatcccagctttttagtct

SEQ ID NO: 418 - DNA, 50 bp, Homo sapiens
gctggggctgagagagggtctgggttatctccttctgatcttcaaaacaa

SEQ ID NO: 419 - DNA, 50 bp, Homo sapiens
tcatggacacaaactttggagtataagcgacatcccttaagcaacaggct

SEQ ID NO: 420 - DNA, 50 bp, Homo sapiens
attcaagtcagggcctctctgcccttttccctccagaaacaaaaccaaga

SEQ ID NO: 421 - DNA, 50 bp, Homo sapiens
tgtttgtaccactagcattcttatgtctgtacttgaacgtgtagttagca

SEQ ID NO: 422 - DNA, 50 bp, Homo sapiens
aatatagctccactaaaggaccatagggaagagccagccttgccttttct

SEQ ID NO: 423 - DNA, 50 bp, Homo sapiens
gacagtccattaagttgatttccagtggtgaagggtcagacacgcctccc

SEQ ID NO: 424 - DNA, 50 bp, Homo sapiens
cctgggttgccttgtaatgaaaagggagatcgagccattgtaccacctta

SEQ ID NO: 425 - DNA, 50 bp, Homo sapiens
gttcactgtttaacagccagaagccagagcctgcgtactagaagtggatg

SEQ ID NO: 426 - DNA, 50 bp, Homo sapiens
ttgtcaagtggatctgccccaaagtttgctttgaggaaacgggcctccct

SEQ ID NO: 427 - DNA, 50 bp, Homo sapiens
cttgtatggaaaacagatgctgacagaattgtagactaccatgccacaca

SEQ ID NO: 428 - DNA, 50 bp, Homo sapiens
aaatctaagacacccaaacccctctttgtccctaagtagccctagcctgg

SEQ ID NO: 429 - DNA, 50 bp, Homo sapiens
agctgtttaattgaattggaatcgttccacttggaacccaagtttggaaa

SEQ ID NO: 430 - DNA, 50 bp, Homo sapiens
tttttctacgttatctcatctccttgttttcagtgtgcttcaataatgca

SEQ ID NO: 431 - DNA, 50 bp, Homo sapiens
ctcccatctgcacacctggatcaaggtagcctctctgcacaagggcaggt

SEQ ID NO: 432 - DNA, 50 bp, Homo sapiens
tgtttttgcttcctcagaaactttttattgcatctgccatccttcattgg

SEQ ID NO: 433 - DNA, 50 bp, Homo sapiens
acagccaactggaaagatataaaagtttgggtctgtctcctctccttcag

SEQ ID NO: 434 - DNA, 50 bp, Homo sapiens
actcctgctttagagagaagccaccatgaaaagtcctcatcatcagggga

SEQ ID NO: 435 - DNA, 50 bp, Homo sapiens
tccgtactgtatgtgatatagtgccattttcagtaactgctgtacacaca

SEQ ID NO: 436 - DNA, 50 bp, Homo sapiens
acttgccattacttttccttcccactctctccaacatcacattcacttta

SEQ ID NO: 437 - DNA, 50 bp, Homo sapiens
gtgagtgtgagcgagagggtgagtgtggtcagagtaaagctgctccaccc

SEQ ID NO: 438 - DNA, 50 bp, Homo sapiens
taatatgctggctttgcagcagaatgaaaaggatgagttggtgtagcctt

SEQ ID NO: 439 - DNA, 50 bp, Homo sapiens
ttccttccctggaggaactctttggttgcagggctaaacttagaggctgc

SEQ ID NO: 440 - DNA, 50 bp, Homo sapiens
tctgacggttgggagtggtggaaattggaaggataccaggaggtatttgg

SEQ ID NO: 441 - DNA, 50 bp, Homo sapiens
tgattacaaaaggcgtattctttcatggtttctgcaatgagaggaagtgt

SEQ ID NO: 442 - DNA, 50 bp, Homo sapiens
tcatgcattggattgctcagaataaagtgtctgttagacttcgttttggt

SEQ ID NO: 443 - DNA, 50 bp, Homo sapiens
tgacgttaacaccaggaatctccatgtttattatttttcgtggaaactcc

SEQ ID NO: 444 - DNA, 50 bp, Homo sapiens
ttgcaaagactcacgtttttgttgttttctcatcattccattgtgatact

SEQ ID NO: 445 - DNA, 50 bp, Homo sapiens
agctgtacatataacccttttctcctaaagaggagtcagtcagtgctcct

SEQ ID NO: 446 - DNA, 50 bp, Homo sapiens
agttcaggagatctctaagtgtagctgtaaattttggggttaatttggct

SEQ ID NO: 447 - DNA, 50 bp, Homo sapiens
tgtttggttgaggggtgcttttagttgtgtggcatttgtattcattgatc

SEQ ID NO: 448 - DNA, 50 bp, Homo sapiens
tcagcctgagtgagttcagcctgtaaaaaggatgttaagctgtgggtaaa

SEQ ID NO: 449 - DNA, 50 bp, Homo sapiens
aggggaaaagaggggagaaaaacaggagtgatgtcatttctttttcatgt

SEQ ID NO: 450 - DNA, 50 bp, Homo sapiens
actttctgcttgtagttgcttaaaattatgtattttgtcttgggctgcaa

SEQ ID NO: 451 - DNA, 50 bp, Homo sapiens
aagcaactgaatcttcagcatgttctcatcggcggagccttcttgtgtaa

SEQ ID NO: 452 - DNA, 50 bp, Homo sapiens
tgattggagcactgaggaacaagggaatgaaaaggcagactctctgaacg

SEQ ID NO: 453 - DNA, 50 bp, Homo sapiens
ttgtccaaacgaagcagccgtggtagtagctgtctatgattcttgctcag

SEQ ID NO: 454 - DNA, 50 bp, Homo sapiens
tggtgcaatagaagctgcaaagatgtgccactttatctatgaaatggagt

SEQ ID NO: 455 - DNA, 50 bp, Homo sapiens
ggcttccatgtccagaatcctgcttaaggttttagggtaccttcagtact

SEQ ID NO: 456 - DNA, 50 bp, Homo sapiens
ttttggccagcttttctagataaggttgtattgctactgcaactaacaaa

SEQ ID NO: 457 - DNA, 50 bp, Homo sapiens
cacacatcctggtacccttggtcttcaaaggccatttccagcagaccctc

SEQ ID NO: 458 - DNA, 50 bp, Homo sapiens
aaacatgtctttttctcgcctcaactttatccacatgaaatgtgtgccca

SEQ ID NO: 459 - DNA, 50 bp, Homo sapiens
taagcataaaacctgacacgttaaaatccctgccctttggtgagcccact

SEQ ID NO: 460 - DNA, 50 bp, Homo sapiens
aacttgcattttagcagtgcatgtttctaattgacttactgggaaactga

SEQ ID NO: 461 - DNA, 50 bp, Homo sapiens
aggcctcaggccacctccaggaacagaacacagttttaagtttgattttt

SEQ ID NO: 462 - DNA, 50 bp, Homo sapiens
tgagtcttagcaatatgggagcaggttttcactgaattctgagggtgcct

SEQ ID NO: 463 - DNA, 50 bp, Homo sapiens
gttgtcctggcacacaaggaggcgaggctatgcgttcgaggccaacctag

SEQ ID NO: 464 - DNA, 50 bp, Homo sapiens
tgggaacacatagaactgatggaggcttttcctaaggccaaggataatgt

SEQ ID NO: 465 - DNA, 50 bp, Homo sapiens
ggattgaacagttcagttgtatctatgccccacagtgaccagtaaagtcc

SEQ ID NO: 466 - DNA, 50 bp, Homo sapiens
cgatgactcattacccaatccccatgaacttgtttcagatttgctctgtt

SEQ ID NO: 467 - DNA, 50 bp, Homo sapiens
gtcgcaaaggggataatctgggaaagacaccaaatcatgggctcacttta

SEQ ID NO: 468 - DNA, 50 bp, Homo sapiens
actcaagctcacacctgtacctgatgggaatgaacataatgtgaagaaac

SEQ ID NO: 469 - DNA, 50 bp, Homo sapiens
caccaaaatagttatgttggcactgtgttcacacgcatggtccccacacc

SEQ ID NO: 470 - DNA, 50 bp, Homo sapiens
gtgcgctttcttttacaacaagcctctagaaacagatagtttctgagaat

SEQ ID NO: 471 - DNA, 50 bp, Homo sapiens
gtgtgtataatgtaaagtagttttgcatattcttgtgctgcacatgggct

SEQ ID NO: 472 - DNA, 50 bp, Homo sapiens
aggaatccttttctacatttgagcaaatactgaggttcatgttgtaccaa

SEQ ID NO: 473 - DNA, 50 bp, Homo sapiens
cgccttggctttgtgttagcatttcctcctgaagtgttctgttggcaata

SEQ ID NO: 474 - DNA, 50 bp, Homo sapiens
agagattttctattgctgggaaggtgtgtttctcccacaatttgtttgtg

SEQ ID NO: 475 - DNA, 50 bp, Homo sapiens
tgcaaccaaattggctttaccatcttggctttagtaggtatagaagacaa

SEQ ID NO: 476 - DNA, 50 bp, Homo sapiens
tgtcaaataaaagagaacgaacaggtagtttggtggagctgagctagtgt

SEQ ID NO: 477 - DNA, 50 bp, Homo sapiens
tcctgtagaaaacgaactgtaaaagaccatgcaagaggcaaaataaaact

SEQ ID NO: 478 - DNA, 50 bp, Homo sapiens
acagtagctttgtagtgggttttctgtgctgtgctttttaatttcatgta

SEQ ID NO: 479 - DNA, 50 bp, Homo sapiens
gattcctgtcatgaaggaaagcaagacagctcacagaccagcggcatctg

SEQ ID NO: 480 - DNA, 50 bp, Homo sapiens
ttttctgtacctttctaaacctctcttccctctgtgatggttttgtgttt

SEQ ID NO: 481 - DNA, 50 bp, Homo sapiens
aaatcttattcctcctcttctcccctcacttttccctacttcctctgcaa

SEQ ID NO: 482 - DNA, 50 bp, Homo sapiens
tggaatcagacatcttccagatggtttggaccctgtccatgtgtaggtca

SEQ ID NO: 483 - DNA, 50 bp, Homo sapiens
aatttagcacctcaggaataacttattggtttaggtcagttcttggcggg

SEQ ID NO: 484 - DNA, 50 bp, Homo sapiens
aaccatgtaactccattgaacatttttcaacttaaggtctgcatagcaga

SEQ ID NO: 485 - DNA, 50 bp, Homo sapiens
aaaccaggttaatggctaagaatgggtaacatgactcttgttggattgtt

SEQ ID NO: 486 - DNA, 50 bp, Homo sapiens
ctcttggctgagcttctacagggctgagagctgcgctttggggacttcag

SEQ ID NO: 487 - DNA, 50 bp, Homo sapiens
tttcctttggggcatgatgttttaacctttgctttagaagcacaagctgt

SEQ ID NO: 488 - DNA, 50 bp, Homo sapiens
atagaatgagcttggttaagcacctctcctttgcccttcaccctgactcc

SEQ ID NO: 489 - DNA, 50 bp, Homo sapiens
ttgagtagaactctgattttccctagaggccaaattctttttatctgggt

SEQ ID NO: 490 - DNA, 50 bp, Homo sapiens
ttctaaacacattcttgatcaccaaacaacttcagaaagacagtgactgt

SEQ ID NO: 491 - DNA, 50 bp, Homo sapiens
tggagttgcttccagctgccaaggcctgtgacagaattcgctgttaagag

SEQ ID NO: 492 - DNA, 50 bp, Homo sapiens
aatgatgcaaagttttattcttgaacttggacactgatgccatcaaacaa

SEQ ID NO: 493 - DNA, 50 bp, Homo sapiens
ggccagtaaattccatgtttttggctatatctcatccaaactgagcagtt

SEQ ID NO: 494 - DNA, 50 bp, Homo sapiens
ttcccattgtcctcctactcaactaaaattcatagttggctttaagccca

SEQ ID NO: 495 - DNA, 50 bp, Homo sapiens
gcatgtcctaatgcttgctgctgatttaaacacattaaaggtactttgca

SEQ ID NO: 496 - DNA, 50 bp, Homo sapiens
acaatggcataaaagtaactttctctgaagatgtgatgttcaggctgtga

SEQ ID NO: 497 - DNA, 50 bp, Homo sapiens
aatggaaggcaggtgaagatataaaaccctagaatgcttaaatgtgctgt

SEQ ID NO: 498 - DNA, 50 bp, Homo sapiens
ttaatgccagtcctcatgtaacctcaggtatcttcagcttgtggagaata

SEQ ID NO: 499 - DNA, 50 bp, Homo sapiens
tggagtatatgcctgaaaaggttttggattcagaaagaaaaaggatggtt

SEQ ID NO: 500 - DNA, 50 bp, Homo sapiens
aaagtaaggcatggttgtggttaatctggtttatttttgttccacaagtt

SEQ ID NO: 501 - DNA, 50 bp, Homo sapiens
ggtgtgtgtgtccagagtgagcaaggattatgtttttggattgtcaaaga

SEQ ID NO: 502 - DNA, 50 bp, Homo sapiens
aaccatttgcctctggctgtgtcacagggtgagccccaaaattggggttc

SEQ ID NO: 503 - DNA, 50 bp, Homo sapiens
gaaagtggagaggacctaacatatgtctctacctagaaaggatggtttca

SEQ ID NO: 504 - DNA, 50 bp, Homo sapiens
accaactataaacccagttctaaagttgtgtatgatggtgaacctttggg

SEQ ID NO: 505 - DNA, 50 bp, Homo sapiens
ggacctgagacactgtggctgtctaatgtaatcctttaaaaattctctgc

SEQ ID NO: 506 - DNA, 50 bp, Homo sapiens
tttggtgttcagttactgagtttcaaaaatgttttggtggcatgaggaca

SEQ ID NO: 507 - DNA, 50 bp, Homo sapiens
cctgtttaagaaagtgaaatgttatggtctcccctcttccaatgagctta

SEQ ID NO: 508 - DNA, 50 bp, Homo sapiens
acggaccaggccattcattattcctcaagtgttaatatactgacttatgc

SEQ ID NO: 509 - DNA, 50 bp, Homo sapiens
acagttttgtcaaaaagtgtatcttgaccccaccatcagtactccattct

SEQ ID NO: 510 - DNA, 50 bp, Homo sapiens
tttggttcatccgtgtgctgttcttttgggttctgagagggttttgccat

SEQ ID NO: 511 - DNA, 50 bp, Homo sapiens
ggcagtaatgcaagagtccttttgtgaagagtgtttctatgtagagatgt

SEQ ID NO: 512 - DNA, 50 bp, Homo sapiens
aaatgcagagcagaatggaccagtggatggacaaggagacaacccaggcc

SEQ ID NO: 513 - DNA, 50 bp, Homo sapiens
agtgttcctgctgccagttctttcctctttaggcgtggttgagaaaaagc

SEQ ID NO: 514 - DNA, 50 bp, Homo sapiens
cagtctctgccacttgtgctagtttttgtgtggtgtttagaaacatgggc

SEQ ID NO: 515 - DNA, 50 bp, Homo sapiens
ttccacttaggtttggcattttggcagataagctaatcttgtataaagca

SEQ ID NO: 516 - DNA, 50 bp, Homo sapiens
gtaaatgccctacatggtgtgatgctgcattatatataaaactgtgtgca

SEQ ID NO: 517 - DNA, 50 bp, Homo sapiens
agctcctgtgctgaccttcaagttacgttttggaactgtaatactaaagg

SEQ ID NO: 518 - DNA, 50 bp, Homo sapiens
acactagggaagaaccttaattctaaatttggttcatgtgtggcaaagtt

SEQ ID NO: 519 - DNA, 50 bp, Homo sapiens
taactggaatcactgccctgctgtaattaaacattctgtaccacatctgt

SEQ ID NO: 520 - DNA, 50 bp, Homo sapiens
cccccagtgctttgtagtctctcctatgtcataataaagctacattttct

SEQ ID NO: 521 - DNA, 50 bp, Homo sapiens
gacagacttggacacaaaaccgatccatagaagggcttcccaaaccttgt

SEQ ID NO: 522 - DNA, 50 bp, Homo sapiens
ccatatgtaacttgttttgaagagaagtgtttccgttgtgtgtcttgatg

SEQ ID NO: 523 - DNA, 50 bp, Homo sapiens
gtatcatctgccaagaccagggcctgcttcaccacagccacaataaagtc

SEQ ID NO: 524 - DNA, 50 bp, Homo sapiens
aatgaaccatttacagttcggttttggactctgagtcaaaggattttcct

SEQ ID NO: 525 - DNA, 50 bp, Homo sapiens
gccgagtcagcacatgggtagagatgatgtaaaagcagccaatctggaaa

SEQ ID NO: 526 - DNA, 50 bp, Homo sapiens
accttctgggaggagggtcggattcaatctgaacttagaactttcaactc

SEQ ID NO: 527 - DNA, 50 bp, Homo sapiens
gcaccatgtagaattttcactttgtactggcaggctcgttttacctcatt

SEQ ID NO: 528 - DNA, 50 bp, Homo sapiens
tctccagtcctgattactgtacacagtagctttagatggcgtggacgtga

SEQ ID NO: 529 - DNA, 50 bp, Homo sapiens
ttcctgttactggcatgtgcacgactatgttattagaagccactttatca

SEQ ID NO: 530 - DNA, 50 bp, Homo sapiens
gccagcttggaggatggacatttctggatacacatacacatacaaaacag

SEQ ID NO: 531 - DNA, 50 bp, Homo sapiens
tcagctccttgatctaagcctcccagagagacccctagaatgtttccctc

SEQ ID NO: 532 - DNA, 50 bp, Homo sapiens
ccggcggcaggaactatcagtagacagctgctgcttccatgaaacggaaa

SEQ ID NO: 533 - DNA, 50 bp, Homo sapiens
tgttgccttgaatataacagtacaatttgtcaattactctgcaccaggct

SEQ ID NO: 534 - DNA, 50 bp, Homo sapiens
aaaagtaacaccctccctttttcctgacagttctttcagctttacagaac

SEQ ID NO: 535 - DNA, 50 bp, Homo sapiens
aatgaaatgtagttgggttcttcctgtaatgcgctattatgtcttgggct

SEQ ID NO: 536 - DNA, 50 bp, Homo sapiens
aacctccttgtgtctgtttctctgttcctctgtggctgactcaataaact

SEQ ID NO: 537 - DNA, 50 bp, Homo sapiens
gtgggagggtgagatgtgaagatgtgggatgaacctggaatgaacgaatt

SEQ ID NO: 538 - DNA, 50 bp, Homo sapiens
ggcctaaagaaagctggggttaatcctgaagctaaaagtaaatgtttctt

SEQ ID NO: 539 - DNA, 50 bp, Homo sapiens
tcccatcctttccatcaagaccttcattagcttatgatatttgctgccga

SEQ ID NO: 540 - DNA, 50 bp, Homo sapiens
ggaggtctcttccagattgctcttctgccgaattatttgtatctattccg

SEQ ID NO: 541 - DNA, 50 bp, Homo sapiens
gcacacctcgtcagaggaccataaccgtgtggggacaataaccgcagggg

SEQ ID NO: 542 - DNA, 50 bp, Homo sapiens
acaatggatttgtgaagagcagattccatgagtaactctgacaggtattt

SEQ ID NO: 543 - DNA, 50 bp, Homo sapiens
tgagagacattgttaattttgggggaattggcattgcgaaagacttgaaa

SEQ ID NO: 544 - DNA, 50 bp, Homo sapiens
tgctagacatttctatactctgttgtaacactgaggtatctcatttgccc

SEQ ID NO: 545 - DNA, 50 bp, Homo sapiens
gtgggggatgggggttaaaaagtagagaacctcctttctgttcaactaat

SEQ ID NO: 546 - DNA, 50 bp, Homo sapiens
caggtgagtagttgccgcgtaatatcattggagtacattctttatactgt

SEQ ID NO: 547 - DNA, 50 bp, Homo sapiens
ccccaaccttattctgtgtgtagacattgtattccacaattttgaatggc

SEQ ID NO: 548 - DNA, 50 bp, Homo sapiens
cgaatggcttaaactaatttgctatgatcctctaacaccgaaatttccca

SEQ ID NO: 549 - DNA, 50 bp, Homo sapiens
agagggaatcagaaaaatgccaagccttttctctttgaatgtgctatttt

SEQ ID NO: 550 - DNA, 50 bp, Homo sapiens
cacccttctctgttaaccttgtgcctgtctcctgtatgatcacatcacca

SEQ ID NO: 551 - DNA, 50 bp, Homo sapiens
tgtgtctctgtcgcgtctgctgtgaagcacatgatgctctatttattgta

SEQ ID NO: 552 - DNA, 50 bp, Homo sapiens
tgagagtaagcacatgacagcgtctgcttgcgttgtgtctgttttatgtt

SEQ ID NO: 553 - DNA, 50 bp, Homo sapiens; identical to SEQ ID NO: 153

SEQ ID NO: 554 - DNA, 50 bp, Homo sapiens
tgcaacgaatatggataccacatagtactttggtgttacctgcttttgaa

SEQ ID NO: 555 - DNA, 50 bp, Homo sapiens
agaactgaatcagtcggaggaacctgaggcaggcgagagtagtactggag

SEQ ID NO: 556 - DNA, 50 bp, Homo sapiens
ttgccatgagataacacagtgtaaacagtagacacccagaaatcgtgact

SEQ ID NO: 557 - DNA, 50 bp, Homo sapiens
gctgttaggctaagagggtgcagggctagacacgaagcttaaactattca

SEQ ID NO: 558 - DNA, 50 bp, Homo sapiens
ccagtgtggaggtagcaaagcatctatctattctgaatcatgtttggaaa

SEQ ID NO: 559 - DNA, 50 bp, Homo sapiens
gccagtatgccacagaatgtcctaaacccttgctgcctcttatcaaaacc

SEQ ID NO: 560 - DNA, 50 bp, Homo sapiens
tttgtactgttgaaaccacttcattggacatgttgcaatagcaaaacccc

SEQ ID NO: 561 - DNA, 50 bp, Homo sapiens
agggggaacattgtaaagaaacaaaaaggtccagatgaatgtatgctaga

SEQ ID NO: 562 - DNA, 50 bp, Homo sapiens
ggtgctgaatatgtccttgtaggctctgttttaagaaaacaatatgtggg

SEQ ID NO: 563 - DNA, 50 bp, Homo sapiens
acattggcttgcttttgttaaagtgcaagtgttacatatggctttgtaca

SEQ ID NO: 564 - DNA, 50 bp, Homo sapiens
ttggtagtgtcagcgggcaccttttacaccttctagtagctcaagctagt

SEQ ID NO: 565 - DNA, 50 bp, Homo sapiens
tcctggaatcgtttaatctaaagcagtttcccctgttttggagattttgt

SEQ ID NO: 566 - DNA, 50 bp, Homo sapiens; identical to SEQ ID NO: 565

SEQ ID NO: 567 - DNA, 50 bp, Homo sapiens
tgagaaagtcctgtgcagtcctgagatgattactcttatttggtgtgctg

SEQ ID NO: 568 - DNA, 50 bp, Homo sapiens
tcgtcttttgcgaatggcttaattctgacactacctttctgggaaatgtt

SEQ ID NO: 569 - DNA, 50 bp, Homo sapiens
tttgattgtgtctgatgggaactgagttgttggcctttgtgaaatgaaat

SEQ ID NO: 570 - DNA, 50 bp, Homo sapiens
ttgacaaagcccaacaatgatctcaggaattacattttccaacagaccaa

SEQ ID NO: 571 - DNA, 50 bp, Homo sapiens
acctgtcacgcttctagttgcttcaaccattttataaccatttttgtaca

SEQ ID NO: 572 - DNA, 50 bp, Homo sapiens
tccttaaggtgcacagtaaatgtacagatagttataggccactgttttgt

SEQ ID NO: 573 - DNA, 50 bp, Homo sapiens
agctcatatgaacactgctctgaactcctctgacttagcattcaacttaa

SEQ ID NO: 574 - DNA, 50 bp, Homo sapiens
catgacaaacattactagcatgttcaactgcaccatgttctggcactgta

SEQ ID NO: 575 - DNA, 50 bp, Homo sapiens
acctctttcctaccaatttcacattttgcagaaacttgttcacatttcca

SEQ ID NO: 576 - DNA, 50 bp, Homo sapiens
gggttgtgtattaaatagccattcattctggaactcaaggacaggactgt

SEQ ID NO: 577 - DNA, 50 bp, Homo sapiens
gccttgcaggtgaccagcagtgtcattgtatttatatacagagcttatga

SEQ ID NO: 578 - DNA, 50 bp, Homo sapiens
ctggacgggcgtgggttctgggtcagcttcttttacctcaattttgtttg

SEQ ID NO: 579 - DNA, 50 bp, Homo sapiens
aaagtctgaggtgtggaacagttatttaagcattagtcaaccctggtcct

SEQ ID NO: 580 - DNA, 50 bp, Homo sapiens
tgggcaagacatgattaatgaatcagaatcctgtttcattggtgacttgg

SEQ ID NO: 581 - DNA, 50 bp, Homo sapiens
cctgtgtaaaagaagaaatacaagagactcaaacacctacacattcacgg

SEQ ID NO: 582 - DNA, 50 bp, Homo sapiens
tggcttgttcatcctccagatgtagctattgatgtacacttcgcaacgga

SEQ ID NO: 583 - DNA, 50 bp, Homo sapiens
aactatcagcttggatggtcacttgaatagaagatggttatacacagtgt

SEQ ID NO: 584 - DNA, 50 bp, Homo sapiens
ccacggtggaccctgtttgttttaaatattctgttcccatgtcaatcagt

SEQ ID NO: 585 - DNA, 50 bp, Homo sapiens
ttgtgtaggaaacttttgcagtttgacactaagataacttctgtgtgcat

SEQ ID NO: 586 - DNA, 50 bp, Homo sapiens
actcaaatcagttagcttcaaacaaaaacgaaagttagaccaagggaacg

SEQ ID NO: 587 - DNA, 50 bp, Homo sapiens; identical to SEQ ID NO: 586

SEQ ID NO: 588 - DNA, 50 bp, Homo sapiens
ttgtgtgctgtgcttcaaagccttaactgtcaaatcttgcattatcttgt

SEQ ID NO: 589 - DNA, 50 bp, Homo sapiens
acattatcatggcatgacttaagggaacattggtttgtgaaggaaaaaca

SEQ ID NO: 590 - DNA, 50 bp, Homo sapiens
tgtgtgactttcatgcttctggggttggagcttaaagatccaaactgaga

SEQ ID NO: 591 - DNA, 50 bp, Homo sapiens
tgctggtattctcactgccacatttttggaaacctgtattacaccttaaa

SEQ ID NO: 592 - DNA, 50 bp, Homo sapiens
ttgagtgtctgcagcagccctggacttccagacttctatcacatgagaaa

SEQ ID NO: 593 - DNA, 50 bp, Homo sapiens
tggtgctgatgcttagttgtctcatgccattaaattgtaaaagtgagttg

SEQ ID NO: 594 - DNA, 50 bp, Homo sapiens
ggaggtcagttgatttccccaggtacattcatggtgtgacagacacatgg

SEQ ID NO: 595 - DNA, 50 bp, Homo sapiens
agatcctttcagtccctagacctccattcactctgtttctcttctgctgg

SEQ ID NO: 596 - DNA, 50 bp, Homo sapiens
gatccgatcatggtgatgtacggggtgaattctcttgccgtgttgcaaat

SEQ ID NO: 597 - DNA, 50 bp, Homo sapiens
atggtttcaaaattcaaggtccccaaatggcagcattttatgttctgacc

SEQ ID NO: 598 - DNA, 50 bp, Homo sapiens
caagtatgtatgcaactttgcacaccaacaactgttaatctgtagctagt

SEQ ID NO: 599 - DNA, 50 bp, Homo sapiens
tggtgattctccaggccatttaataccctgcaatgtaattgtccctctgt

SEQ ID NO: 600 - DNA, 50 bp, Homo sapiens
ttctgcctcaatgtttactgtgcctttgtttttgctagtttgtgttgttg

SEQ ID NO: 601 - DNA, 50 bp, Homo sapiens
actactgtcacgtagctgtgtacaaagagatgtgaaatactttcaggcaa

SEQ ID NO: 602 - DNA, 50 bp, Homo sapiens
tgttgaacggttaaactgtgcatttctcattttgatgtgtcatgtatgtt

SEQ ID NO: 603 - DNA, 50 bp, Homo sapiens
aatggtcaaggttcagcatattctatatgaagatcacaaggtggtatcgt

SEQ ID NO: 604 - DNA, 50 bp, Homo sapiens
tgtgaacttgtgcgcaaatgtgcagattcaatgttcttgttacagattga

SEQ ID NO: 605 - DNA, 50 bp, Homo sapiens
ccccttgggctcagcacgaaagggctttcaatgaattaagtgaaaacttt

SEQ ID NO: 606 - DNA, 50 bp, Homo sapiens
aatgagttgtgttgaagcctccgtctcccatccttgcctgtagcccgtag

SEQ ID NO: 607 - DNA, 50 bp, Homo sapiens
agcctaaacatgtatactgtgcattttatgggtgactttgaaagatctgt

SEQ ID NO: 608 - DNA, 50 bp, Homo sapiens
accaggttttagcaaaatgcacacttttggctctttttggtatatgttct

SEQ ID NO: 609 - DNA, 50 bp, Homo sapiens
cctgactcctccttgcaaacaaaatgatagttgacactttatcctgattt

SEQ ID NO: 610 - DNA, 50 bp, Homo sapiens
ttgtattggcataatcagtgacttgtacattcagcaatagcatttgagca

SEQ ID NO: 611 - DNA, 50 bp, Homo sapiens
ttgttaagttgcaattactgcaatgacagaccaataaacaattgctgcca

SEQ ID NO: 612 - DNA, 50 bp, Homo sapiens
acagcaaactttggcatttatgtggagcatttctcattgttggaatctga

SEQ ID NO: 613 - DNA, 50 bp, Homo sapiens
tggtcattctgctgtgttcattaggtgccaatgtgaagtctggattttaa

SEQ ID NO: 614 - DNA, 50 bp, Homo sapiens
ggcatgaaatgagggacaaagaaagcatctcgtaggtgtgtctactgggt

SEQ ID NO: 615 - DNA, 50 bp, Homo sapiens
aatcttgacacatgcaattgtaaataaaagtcaccacttttgccaagctt

SEQ ID NO: 616 - DNA, 50 bp, Homo sapiens
tgatgccttcatctgttcagtcatctccaaaaacagtaaaaataaccact

SEQ ID NO: 617 - DNA, 50 bp, Homo sapiens
ggccaagctgaatgccatgaatatcagtgagacgcgttataaggaatcct

SEQ ID NO: 618 - DNA, 50 bp, Homo sapiens
cctgccagtgtcagaaaatcctatttatgaatcctgtcggtattccttgg

SEQ ID NO: 619 - DNA, 50 bp, Homo sapiens
tcaagaatttgggtgggagaaaagaaagtgggttatcaagggtgatttga

SEQ ID NO: 620 - DNA, 50 bp, Homo sapiens
caaactggtgcagaaattctataaactctttgctgtttttgatacctgct

SEQ ID NO: 621 - DNA, 50 bp, Homo sapiens
gctacttgtttacattgtacactgcgaccaccttgccgcttttcatcaca

SEQ ID NO: 622 - DNA, 50 bp, Homo sapiens
actggatgctacagacttataacagcatagtgaatggtaagactagtgca

SEQ ID NO: 623 - DNA, 50 bp, Homo sapiens
cctcccctatgcctcagccccatctctgctcctgtttgaattttgttatt

SEQ ID NO: 624 - DNA, 50 bp, Homo sapiens
ccagtgtgactagggatcctgagttttctgggacaattccagctttaatc

SEQ ID NO: 625 - DNA, 50 bp, Homo sapiens
tgacccttctttaagttatgtgtgtggggagaaatagaatggtgctctta

SEQ ID NO: 626 - DNA, 50 bp, Homo sapiens
gtgtgagtcctctgtttgcactggacatattccctacctgtcttatttca

SEQ ID NO: 627 - DNA, 50 bp, Homo sapiens
aggggaaggggtgcctggcgggtacttttctatcttttatttccagattt

SEQ ID NO: 628 - DNA, 50 bp, Homo sapiens
tcatgcttctgccctgtcaaaggtccctatttgaaatgtgttataataca

SEQ ID NO: 629 - DNA, 50 bp, Homo sapiens
agctagcagatcgtagctagtttgtattgtcttgtcaattgtacagactt

SEQ ID NO: 630 - DNA, 50 bp, Homo sapiens
agcccagaattcccaaaggcattaggtttcccaactgctttgtgctgata

SEQ ID NO: 631 - DNA, 50 bp, Homo sapiens
gtgtctatacatttctaagccttgtttgcagaataaacagggcatttagc

SEQ ID NO: 632 - DNA, 50 bp, Homo sapiens
tagaggtgtacagatgctatattatatccgctcccggtgtactgcagccc

SEQ ID NO: 633 - DNA, 50 bp, Homo sapiens
ttttacaaggaaggggtagtaattggcccactctcttcttactggaggct

SEQ ID NO: 634 - DNA, 50 bp, Homo sapiens
acacggtgaactggctgtgtccatctttgtcactgagtgaaatctctgtt

SEQ ID NO: 635 - DNA, 50 bp, Homo sapiens
tgaggacttggggcaggaaaggaatgctgctgaacttgaatttcccttta

SEQ ID NO: 636 - DNA, 50 bp, Homo sapiens
tcagaccttggatcagatgaactcttagaaatgaaggcagaaaaatgtca

SEQ ID NO: 637 - DNA, 50 bp, Homo sapiens
ccacgttcttgttccgatactctgagaagtgcctgatgttgatgtactta

SEQ ID NO: 638 - DNA, 50 bp, Homo sapiens
gcctgggtcagatttttattgtggggtgggatgagtaggacaacatattt

SEQ ID NO: 639 - DNA, 50 bp, Homo sapiens
gggtgcccacctgcatgtgaaggggaggcagttctcaatttatttcaata

SEQ ID NO: 640 - DNA, 50 bp, Homo sapiens
cagtcactgggtctatattaaacagcaaccagagcaacaaatggcaaaca

SEQ ID NO: 641 - DNA, 50 bp, Homo sapiens
tgacatggtagcagaaataggcccttttatgtgttgcttctattttacct

SEQ ID NO: 642 - DNA, 50 bp, Homo sapiens
agcaaagaacagtttggtggtcttttctcttccactgatttttctgtaat

SEQ ID NO: 643 - DNA, 50 bp, Homo sapiens
agccctgctaaactatgtacagaggaaactgttcaagtattggatttgaa

SEQ ID NO: 644 - DNA, 50 bp, Homo sapiens
tgtcaacgatgtttccagtagtgtttagatttggtgtcttcaaaggtagt

SEQ ID NO: 645 - DNA, 50 bp, Homo sapiens
ggctttttgcccatcaagaataaaaagaaataaaaccaaagggttaccgg

SEQ ID NO: 646 - DNA, 50 bp, Homo sapiens
tgcctgttgcacatcttgtaaaattggacaatggctctttagagagttat

SEQ ID NO: 647 - DNA, 50 bp, Homo sapiens
tgcggctagttcagagagatttttagagctgtggtggacttcatagatga

SEQ ID NO: 648 - DNA, 50 bp, Homo sapiens
aatggaaggattagtatggcctatttttaaagctgctttgttaggttcct

SEQ ID NO: 649 - DNA, 50 bp, Homo sapiens
ccatgtgggctactcatgatgggcttgattctttgggaataataaaatga

SEQ ID NO: 650 - DNA, 50 bp, Homo sapiens
aacgaggccagtggggaacccttacctaagtatgtgattgacaaatcatg

SEQ ID NO: 651 - DNA, 50 bp, Homo sapiens
cctctcaggacgtgccgggtttatcattgctttgttatttgtaaggactg

SEQ ID NO: 652 - DNA, 50 bp, Homo sapiens
ccactgcctgaaaggtttgtacagatgcatgccacagtagatgtccacat

SEQ ID NO: 653 - DNA, 50 bp, Homo sapiens
ttttgggataaattttactggttgctgttgtggagaaggtggcgtttcca

SEQ ID NO: 654 - DNA, 50 bp, Homo sapiens
tgaagtataagcctctactgggtctatattgtgaatcatcctgcctttca

SEQ ID NO: 655 - DNA, 50 bp, Homo sapiens
ctcgtctattggcccctgtagaaagttaacctttgttgttttccttttat

SEQ ID NO: 656 - DNA, 50 bp, Homo sapiens
tccccttctgtcccctagtaagcccagttgctgtatctgaacagtttgag

SEQ ID NO: 657 - DNA, 50 bp, Homo sapiens
aaacctatttcccttgcctcataggcttctgggatgtcatcacctccagt

SEQ ID NO: 658 - DNA, 50 bp, Homo sapiens
gaatttggtggtgtcaattgcttatttgttttcccacggttgtccagcaa

SEQ ID NO: 659 - DNA, 50 bp, Homo sapiens
ctattttgggtcatttttatgtacctttgggttcaggcattatttggggg

SEQ ID NO: 660 - DNA, 50 bp, Homo sapiens
taattgttgaacaggtgtttttccacaagtgccgcaaattgtaccttttt

SEQ ID NO: 661 - DNA, 50 bp, Homo sapiens
ccccctcagaagaatcatgaatttgcaacagacctaatttttggttactt

SEQ ID NO: 662 - DNA, 50 bp, Homo sapiens
ggcctttccattccatttattcacactgagtgtcctacaataaacttccg

SEQ ID NO: 663 - DNA, 50 bp, Homo sapiens
tggtgtctcaaaggagtaactgcagcttggtttgaaatttgtactgtttc

SEQ ID NO: 664 - DNA, 50 bp, Homo sapiens
tgccagtagtgaccaagaacacagtgattatatacactatactggaggga

SEQ ID NO: 665 - DNA, 50 bp, Homo sapiens
aggacacatctgacatcctgtgtttggttaaaatatacagcacattgtga

SEQ ID NO: 666 - DNA, 50 bp, Homo sapiens
tgggggttgtaaattggcatggaaatttaaagcaggttcttgttagtgca

SEQ ID NO: 667 - DNA, 50 bp, Homo sapiens
tgtgaaagaaacttgcttgcagctttaacaaaatgagaaacttcccaaat

SEQ ID NO: 668 - DNA, 50 bp, Homo sapiens
gtatatatcctccagcattcagtccagggggagccacggaaaccatgttc

SEQ ID NO: 669 - DNA, 50 bp, Homo sapiens
tgtgatgctaggaacatgagcaaactgaaaattactatgcacttgtcaga

SEQ ID NO: 670 - DNA, 50 bp, Homo sapiens
aacccagtatatctgtgttatctgatgggacggttgacagtggtcaggga

SEQ ID NO: 671 - DNA, 50 bp, Homo sapiens
atccagtggcctaggaattaaagtgttgttgtttttgctgttaaattgga

SEQ ID NO: 672 - DNA, 50 bp, Homo sapiens
gcattggcagcattgtgtctttgaccttgtatactagcttgacatagtgc

SEQ ID NO: 673 - DNA, 50 bp, Homo sapiens
tttcatggtgtgaaggaaggagcgtggtgcattggacatgggtctgacac

SEQ ID NO: 674 - DNA, 50 bp, Homo sapiens
agactgcacaaccaagaagttactcaaagctctgtgggagcccctgcctg

SEQ ID NO: 675 - DNA, 50 bp, Homo sapiens
cagtgctcacctaaatccatctgactacttgttcctgtgccctcttgttt

SEQ ID NO: 676 - DNA, 50 bp, Homo sapiens
gtgacgacgacctgaaggagacgggcttccaccttaccaccacgaaccag

SEQ ID NO: 677 - DNA, 50 bp, Homo sapiens
aacaggataaagctcgccgggaatgggaaagacagaagagaagggaaatg

SEQ ID NO: 678 - DNA, 50 bp, Homo sapiens
cctcacccccaccctcactttcaatccgtttgataccatttggctccttt

SEQ ID NO: 679 - DNA, 50 bp, Homo sapiens
atggaaagatgtggtctgagatgggtgctgcaaagatcataataaagtca

SEQ ID NO: 680 - DNA, 50 bp, Homo sapiens
ccatgacttcacagacatggtctagaatctgtacccttacccacatatga

SEQ ID NO: 681 - DNA, 50 bp, Homo sapiens
ctgtgaatgtttgcagtctcctaccgtctcaactacagctgcagttgcta

SEQ ID NO: 682 - DNA, 50 bp, Homo sapiens
cagcctgaattgcctctgggaagaggggtgggaatgacttttcaatgtac

SEQ ID NO: 683 - DNA, 50 bp, Homo sapiens
aatggcctagaatttgtggtagttgccaaagaggttctcctaggtggtct

SEQ ID NO: 684 - DNA, 50 bp, Homo sapiens
cagtgaaaagtttgtgagtgaagaatgctgagaagattgtaatgctttgt

SEQ ID NO: 685 - DNA, 50 bp, Homo sapiens
ttgtctcaaagctaccaagtttgtgcaataagtggaagggatgtcatcct

SEQ ID NO: 686 - DNA, 50 bp, Homo sapiens
acatcgaaggtgtgcatatatgttgaatgacattttagggacatggtgtt

SEQ ID NO: 687 - DNA, 50 bp, Homo sapiens
ggctatctcaggcaatatggccagcacctgggtctttatgcatgaagata

SEQ ID NO: 688 - DNA, 50 bp, Homo sapiens
gctgtcacggagcgactgtcgagatcgcctagtatgttctgtgaacacaa

SEQ ID NO: 689 - DNA, 50 bp, Homo sapiens
agctgctgacttgactgtcatcctgttcttgttagccattgtgaataaga

SEQ ID NO: 690 - DNA, 50 bp, Homo sapiens
ctcacaggtggactgagaaatcagttacatcttaagtgacctacagggta

SEQ ID NO: 691 - DNA, 50 bp, Homo sapiens
gtgcattgtatttagtctgtattgatcatggatgccctccttaatagcca

SEQ ID NO: 692 - DNA, 50 bp, Homo sapiens
cctgtacaattgcatcacgggtggggataaaaagaggaatattctggttt

SEQ ID NO: 693 - DNA, 50 bp, Homo sapiens
aaacagagctgtcttcagcaacattattagtagacaaagaggatgtggat

SEQ ID NO: 694 - DNA, 50 bp, Homo sapiens
actcaagttttcagtttgtaccgcctggtatgtctgtgtaagaagccaat

SEQ ID NO: 695 - DNA, 50 bp, Homo sapiens
tgactcctgccaagaaatcctttcttagaaggttgtttgattagttttgc

SEQ ID NO: 696 - DNA, 50 bp, Homo sapiens
ttgtattatctgctttgctgatgtagacaagagttaactgagtagcatgc

SEQ ID NO: 697 - DNA, 50 bp, Homo sapiens
aaagattgttggttaggccagattgacacctatttataaaccatatgcgt

SEQ ID NO: 698 - DNA, 50 bp, Homo sapiens
tggtaactgttccaggattgctccaggtttgagatggtattgctaaattt

SEQ ID NO: 699 - DNA, 50 bp, Homo sapiens
tgcaccttgtagtggattctgcatatcatctttcccacctaaaaatgtct

SEQ ID NO: 700 - DNA, 50 bp, Homo sapiens
cactagcacttgtgatgcaatagaacacttcgcctgtactgaaagggcca

SEQ ID NO: 701 - DNA, 50 bp, Homo sapiens
acgcaggctttcctatttctacaactgattgtacttatgcattttgtacc

SEQ ID NO: 702 - DNA, 50 bp, Homo sapiens
caggagctactttgagtttggtgttactaggatcagggtcagtctttggc

SEQ ID NO: 703 - DNA, 50 bp, Homo sapiens
tagagagaggcccgtggcctgaggtagtgcagaggaggatagtagagcag

SEQ ID NO: 704 - DNA, 50 bp, Homo sapiens
ttttggaagattttcagtctagttgccaaatctggctcctttacaaaaga

SEQ ID NO: 705 - DNA, 50 bp, Homo sapiens
aagttaattgaggcaatgtcatctgctcaaagttgagtggtttattcaca

SEQ ID NO: 706 - DNA, 50 bp, Homo sapiens
ttgcagtgtattactgtcagcagtatggtagctcaccgtggacgttcggc

SEQ ID NO: 707 - DNA, 50 bp, Homo sapiens
tattctgtgttaatggctaacctgttacactgggctgggttgggtagggt

SEQ ID NO: 708 - DNA, 50 bp, Homo sapiens
aaactgaatgagagaaaattgtataaccatcctgctgttcctttagtgca

SEQ ID NO: 709 - DNA, 50 bp, Homo sapiens
tgacactggtcttgcagtacaactggaagccaaaacaaggtggaagatgt

SEQ ID NO: 710 - DNA, 50 bp, Homo sapiens
ggtcaagtatatttggacctattatcctcggcaagccaagatgcaaacat

SEQ ID NO: 711 - DNA, 50 bp, Homo sapiens
agttcacaatatggttcaaatgtaacagtgcagaattgaatatggaggca

SEQ ID NO: 712 - DNA, 50 bp, Homo sapiens
ttgcatctttccaggagagcctcacattcttcttccaggttgtatcaccc

SEQ ID NO: 713 - DNA, 50 bp, Homo sapiens
gtgagtcaggagcaggagcgtgcggaccaaaaatcctcagcccttacgac

SEQ ID NO: 714 - DNA, 50 bp, Homo sapiens
tcaccttatgcaatgtgaattatcactacagaactccatcttactccaga

SEQ ID NO: 715 - DNA, 50 bp, Homo sapiens
tttgatgtaatataacctaacgttgtgctggtacctgttttaccatgtgt

SEQ ID NO: 716 - DNA, 50 bp, Homo sapiens
ctccatccctggccccctccctggatgacattaaagaagggttgagctgg

SEQ ID NO: 717 - DNA, 50 bp, Homo sapiens; identical to SEQ ID NO: 716

SEQ ID NO: 718 - DNA, 50 bp, Homo sapiens
ggcttagctgccagtctcccatttgtgacctatgccatccatctataatg

SEQ ID NO: 719 - DNA, 50 bp, Homo sapiens
ggccccaatgccaactcttaagtcttttgtaattctggctttctctaata

SEQ ID NO: 720 - DNA, 50 bp, Homo sapiens
tgtcaggtttgggtcttgggttcaagtgtatatattcctgtaagtttctt

SEQ ID NO: 721 - DNA, 50 bp, Homo sapiens; identical to SEQ ID NO: 75

SEQ ID NO: 722 - DNA, 50 bp, Homo sapiens
ttgacattctgcgaaagcaacaagcaaactgaagaccaactcctatgaga

SEQ ID NO: 723 - DNA, 50 bp, Homo sapiens
cgcctcttcaggttcttaagggattctccgttttggttccattttgtaca

SEQ ID NO: 724 - DNA, 50 bp, Homo sapiens
ccttgttggacagggggacaggctgcctactggaatgtaaatatgtgata

SEQ ID NO: 725 - DNA, 50 bp, Homo sapiens
tttctgaatgcctacctggcggtgtataccaggcagtgtcccagtttaaa

SEQ ID NO: 726 - DNA, 50 bp, Homo sapiens
tgtgcaaggggagcacatattggatgtatatgttaccatatgttaggaaa

SEQ ID NO: 727 - DNA, 50 bp, Homo sapiens
tcaagtgaacatctcttgccatcacctagctgcctgcacctgcccttcag

SEQ ID NO: 728 - DNA, 50 bp, Homo sapiens
ccgaggagaagcgcgagggctacgagcgtctcctgaagatgcaaaaccag

SEQ ID NO: 729 - DNA, 50 bp, Homo sapiens
gcagctgtttgaagtttgtatattttccgtactgcagagcttacacaaaa

SEQ ID NO: 730 - DNA, 50 bp, Homo sapiens
gcctgtgaaatagtactgcacttacataaagtgagacattgtgaaaaggc

SEQ ID NO: 731 - DNA, 50 bp, Homo sapiens
gctctgattgtacaagaattacctgtgctagtcaagttgttgtttttcct

SEQ ID NO: 732 - DNA, 50 bp, Homo sapiens
ctgtcttttgtagctctggactggaggggtagatggggagtcaattaccc

SEQ ID NO: 733 - DNA, 50 bp, Homo sapiens
ggtacaaccttcaactatttcttccatgcggaccccctcctgccaaaaga

SEQ ID NO: 734 - DNA, 50 bp, Homo sapiens
gcaattctccctgcgtcatggatttcaaggtcttttaatcaccttcggtt

SEQ ID NO: 735 - DNA, 50 bp, Homo sapiens
ccttcgctttaacataggtctaatttatttgccgtgccattttccataca

SEQ ID NO: 736 - DNA, 50 bp, Homo sapiens
tggttggaagtgggtggggttatgaaattgtagatgtttttagaaaaact

SEQ ID NO: 737 - DNA, 50 bp, Homo sapiens
accttcctccaggaaaagccattcaagcctgattatttttctaagtaact

SEQ ID NO: 738 - DNA, 50 bp, Homo sapiens
ctgtatagctttccccacctcccacaaaatcacccagttaatgtgtgtgt

SEQ ID NO: 739 - DNA, 50 bp, Homo sapiens
ggggtacctgtgttgagttgataaacatttccatcttcattaaaactgct

SEQ ID NO: 740 - DNA, 50 bp, Homo sapiens
tgtccacctttgcagcctgtttctgtcatgtagtttcaacaagtgctacc

SEQ ID NO: 741 - DNA, 50 bp, Homo sapiens
atgctacctcaaagtgctaccgataaacctttctaattgtaagtgccctt

SEQ ID NO: 742 - DNA, 50 bp, Homo sapiens
agcacccattccgaccatagtataatcatatcaaagggtgagaatcattt

SEQ ID NO: 743 - DNA, 50 bp, Homo sapiens
tgtggtttaagctgtactgaactaaatctgtggaatgcattgtgaactgt

SEQ ID NO: 744 - DNA, 50 bp, Homo sapiens
attacgaagatgaaccagtaaacgaggacatggagtgactatcggggcgg

SEQ ID NO: 745 - DNA, 50 bp, Homo sapiens
tcctccagctgacagaaaaatccaggatgagatcagaaggatactggtgt

SEQ ID NO: 746 - DNA, 50 bp, Homo sapiens
tttacacgccctgaagcagtcttctttgctagttgaattatgtggtgtgt

SEQ ID NO: 747 - DNA, 50 bp, Homo sapiens
gttcacggaaaagccagaacctgctgttttcagggtgggtgatgtaaata

SEQ ID NO: 748 - DNA, 50 bp, Homo sapiens
agtgctcttgctttggataactgtaaagggacccatgctgatagactgga

SEQ ID NO: 749 - DNA, 50 bp, Homo sapiens
tgccccagttgtcagtcagagccgttggtgtttttcattgtttaaaatgt

SEQ ID NO: 750 - DNA, 50 bp, Homo sapiens
aaaccaatggacaaacttcttgcttcaaggaacaaactcttaggttggca

SEQ ID NO: 751 - DNA, 50 bp, Homo sapiens
aaacatcatgagagtggaggcctgccacccagaaaggcacatactagtgc

SEQ ID NO: 752 - DNA, 50 bp, Homo sapiens
agtggattaacccctgcttctcttcttgttccctgttatcattcctcccc

SEQ ID NO: 753 - DNA, 50 bp, Homo sapiens
gtctgcttattcgtgtctcttactaggttcaatttcttggaggccgtgat

SEQ ID NO: 754 - DNA, 50 bp, Homo sapiens
tggcctgactgacatgcagttccataaatgcagatgtttgtctcattacc

SEQ ID NO: 755 - DNA, 50 bp, Homo sapiens
gccagacttgaaagagggctccagaaaaagtagatgcgtatctgtacaaa

SEQ ID NO: 756 - DNA, 50 bp, Homo sapiens
cgtcttaatgttcaccgtccacagctttggaataaaccatcctgggaagt

SEQ ID NO: 757 - DNA, 50 bp, Homo sapiens
ttaatgttcaccgtccacagctttggaataaaccatcctgggaagttgct

SEQ ID NO: 758 - DNA, 50 bp, Homo sapiens
tctagcccagcattgatctagaagcagaggaatcccagcgccttttaaaa

SEQ ID NO: 759 - DNA, 50 bp, Homo sapiens
ttgctcagcatgccagcctttaagattgaattagattgtgttgttgtggt

SEQ ID NO: 760 - DNA, 50 bp, Homo sapiens
aaaaggtatagaaatgctggttggaatgcttatttgaaaaagactggcca

SEQ ID NO: 761 - DNA, 50 bp, Homo sapiens
ctgcttcacgcctgtgtctccgcagcacttcatcgacctcttcaagtttt

SEQ ID NO: 762 - DNA, 50 bp, Homo sapiens
agagcagcttgtgtatgtaaacgcttcagtgaacttgctaatgatccaat

SEQ ID NO: 763 - DNA, 50 bp, Homo sapiens
tcaaacctactaatccagcgacaatttgaatcggttttgtaggtagagga

SEQ ID NO: 764 - DNA, 50 bp, Homo sapiens
tcaacctccgtcatgttttagaaaccttttatcttttccttcctcatgct

SEQ ID NO: 765 - DNA, 50 bp, Homo sapiens
tttccatctgtgtcccagattgtgaccctagactttcaattgacaagtaa

SEQ ID NO: 766 - DNA, 50 bp, Homo sapiens
catgtcgttagatggaacatggaagccattgtctaatcaactctatcatt

SEQ ID NO: 767 - DNA, 50 bp, Homo sapiens
atgtaatcctgtaggttggtacttcccccaaactgattataggtaacagt

SEQ ID NO: 768 - DNA, 50 bp, Homo sapiens
tgaatgatcagaactgacatttaattcatgtttgtctcgccatgcttctt

SEQ ID NO: 769 - DNA, 50 bp, Homo sapiens
tttgcacattttacatatgctatgtggttgcctttgggttttctgtacag

SEQ ID NO: 770 - DNA, 50 bp, Homo sapiens
tggtcatgttccaggtgctagtacatcattcatgatcaccttaatgctca

SEQ ID NO: 771 - DNA, 50 bp, Homo sapiens
agcataaagagttgtggatcagtagccattttagttactgggggtggggg

SEQ ID NO: 772 - DNA, 50 bp, Homo sapiens
tcaacactttgctttatttgacacaaccagactttctcagttcctgttct

SEQ ID NO: 773 - DNA, 50 bp, Homo sapiens
atgaagaaaatcattgagactgttgcagaaggagggggagaacttggagt

SEQ ID NO: 774 - DNA, 50 bp, Homo sapiens
actgaaagacttttgcttaaagtggcattattgactgctgatgtgatgct

SEQ ID NO: 775 - DNA, 50 bp, Homo sapiens
ttggttggtaactctgtaattcctaactatcactggtttggttctggact

SEQ ID NO: 776 - DNA, 50 bp, Homo sapiens
ccaccatatatactagctgttaatcctatggaatggggtattgggagtgc

SEQ ID NO: 777 - DNA, 50 bp, Homo sapiens
agaggaatctgaaagtgcagggtgttggttaaagttgtacctcccaagta

SEQ ID NO: 778 - DNA, 50 bp, Homo sapiens
tttttctccatcctgtttctagcacaaaaatttgcctgctgtgttacaaa

SEQ ID NO: 779 - DNA, 50 bp, Homo sapiens
cagattgatttgaaaggtgtgcagcctgatttaaaaccaaaccctgaacc

SEQ ID NO: 780 - DNA, 50 bp, Homo sapiens
gcaactaataagccaaggaatcgacatatattaggtgcgtgtactgtttc

SEQ ID NO: 781 - DNA, 50 bp, Homo sapiens
tgtccagtgataaatgtgattgatcttgccttttgtacatggaggtcacc

SEQ ID NO: 782 - DNA, 50 bp, Homo sapiens; identical to SEQ ID NO: 758

SEQ ID NO: 783 - DNA, 50 bp, Homo sapiens
agggaacagtgtggagatgtttttgtcttgtccaaataaaagattcacca

SEQ ID NO: 784 - DNA, 50 bp, Homo sapiens
acccattggtatacacagaatattcctgtgcccacacttaatgtcaatct

SEQ ID NO: 785 - DNA, 50 bp, Homo sapiens
ttgatgataccaccagtaaaaataggatgtttaccccaaaacaagtgtca

SEQ ID NO: 786 - DNA, 50 bp, Homo sapiens
tttcaaccgaaagggcagatccaatagaagacccgctccttaaataaaca

SEQ ID NO: 787 - DNA, 50 bp, Homo sapiens
acagaggcaaagttaagcttgatgatggttaaaatcggtttgatagcacc

SEQ ID NO: 788 - DNA, 50 bp, Homo sapiens
tggttgatttccctcattgtgtaaacattgacaggtatgtgacaaatggg

SEQ ID NO: 789 - DNA, 50 bp, Homo sapiens
cacaaactagattctggacaccagtgtgcggaaatgcttctgctacattt

SEQ ID NO: 790 - DNA, 50 bp, Homo sapiens
ggccctctttcctgtctgtgtaaattgttccgtgaagccgcgctctgttt

SEQ ID NO: 791 - DNA, 50 bp, Homo sapiens
cactgtcctttctccaggccctcagatggcacattagggtgggcgtgctg

SEQ ID NO: 792 - DNA, 50 bp, Homo sapiens
aggagctatgattagacttctgttagacttcctcactctatcacccacat

SEQ ID NO: 793 - DNA, 50 bp, Homo sapiens
acccactttctccttggtaaagcgtttacttaacaaaataatacccgaga

SEQ ID NO: 794 - DNA, 50 bp, Homo sapiens
gtcacacatgacacaagatgtacataatatcatgctcacgcctggagtgt

SEQ ID NO: 795 - DNA, 50 bp, Homo sapiens
atgtgcatgtgaatggcctagagaacctatttttgtgtctaaagtttaca

SEQ ID NO: 796 - DNA, 50 bp, Homo sapiens
agatcctgtcctcctttagcctcactaatcaagttgggtcctatcttccc

SEQ ID NO: 797 - DNA, 50 bp, Homo sapiens
agttgttagttgccctgctacctagtttgttagtgcatttgagcacacat

SEQ ID NO: 798 - DNA, 50 bp, Homo sapiens
aatcctttaactctgcggatagcatttggtaggtagtgattaactgtgaa

SEQ ID NO: 799 - DNA, 50 bp, Homo sapiens
ggaggaggagcttatttcttggtgtacttgaatcagaaggtccctgcaag

SEQ ID NO: 800 - DNA, 50 bp, Homo sapiens; identical to SEQ ID NO: 799

SEQ ID NO: 801 - DNA, 50 bp, Homo sapiens
aagtggaagtgggtgaattctactttttatgttggagtggaccaatgtct

SEQ ID NO: 802 - DNA, 50 bp, Homo sapiens
tgggattcattggcccataggtacattggaaaatgtatatctctccagct

SEQ ID NO: 803 - DNA, 50 bp, Homo sapiens
gggacccccaggaggctgaggatgggagacagagaccagactgtgacttg

SEQ ID NO: 804 - DNA, 50 bp, Homo sapiens
tgtttgtagcacacttgagtttgtgtattccattgacatcaaatgtgaca

SEQ ID NO: 805 - DNA, 50 bp, Homo sapiens
cgatctgtgtttgctctgacgaatggaatttatcctcacaaattggtgtt

SEQ ID NO: 806 - DNA, 50 bp, Homo sapiens
ccaggagcgtggttttctgattgtgatctgaggttctgccccaactgcac

SEQ ID NO: 807 - DNA, 50 bp, Homo sapiens
acattacctaatattctcactagctatgttctccaatccacactgccttt

SEQ ID NO: 808 - DNA, 50 bp, Homo sapiens
agacagccctgccaaagccataccaaagacactcaaagacagccaataaa

SEQ ID NO: 809 - DNA, 50 bp, Homo sapiens
agagatagcacagatggaccaaaggttatgcacaggtgggagtcttttgt

SEQ ID NO: 810 - DNA, 50 bp, Homo sapiens; identical to SEQ ID NO: 809

SEQ ID NO: 811 - DNA, 50 bp, Homo sapiens
gcctttcttcctctcccaacataacaatcgtggtaacagaatgcgactgc

SEQ ID NO: 812 - DNA, 50 bp, Homo sapiens
accgtgtaaagtggggatggggtaaaagtggttaacgtactgttggatca

SEQ ID NO: 813 - DNA, 50 bp, Homo sapiens
gcccagtgcttaaaaacgccttcttgcatgaggggattgaactatacaat

SEQ ID NO: 814 - DNA, 50 bp, Homo sapiens
gcgggaaggcatgtaaccacctaaaccatctccgagaacatcagaggatc

SEQ ID NO: 815 - DNA, 50 bp, Homo sapiens
tgtcaggctggcttggttaggttttactggggcagaggatagggaatctc

SEQ ID NO: 816 - DNA, 50 bp, Homo sapiens
ggtggattccaaatgaacccctgcgttagttacaaaggaaaccaatgcca

SEQ ID NO: 817 - DNA, 50 bp, Homo sapiens
atttatcgtaaacatccacgagtgctgttgcactaccatctatttgttgt

SEQ ID NO: 818 - DNA, 50 bp, Homo sapiens
tgggggttgtaaattggcatggaaatttaaagcaggttcttgttggtgca

SEQ ID NO: 819 - DNA, 50 bp, Homo sapiens
gataggggcggcccggagccagccaggcagttttattgaaatctttttaa

SEQ ID NO: 820 - DNA, 50 bp, Homo sapiens
catttgtaccctaggcccacgaacccacgagaatgtcctctgacttccag

SEQ ID NO: 821 - DNA, 50 bp, Homo sapiens
agtgggattttatgccagttgttaaaatgagcattgatgtacccattttt

SEQ ID NO: 822 - DNA, 50 bp, Homo sapiens
ctttcctttgctccctcccatgtttctggtggactaaattgtgtatctgg

SEQ ID NO: 823 - DNA, 50 bp, Homo sapiens
agttttctagattgtcacatgctttgtgactaatgcaagaaagcaagtcc

SEQ ID NO: 824 - DNA, 50 bp, Homo sapiens
gaaacactttcaggaccttccttcctcttgcagttgttctttaatctcct

SEQ ID NO: 825 - DNA, 50 bp, Homo sapiens
ctcgaggggccaattacaggagcacaggaaggttctgattacacacctct

SEQ ID NO: 826 - DNA, 50 bp, Homo sapiens
ttgagttaagttgcatttctttgggctatgaaggagtcctcttaagtttg

SEQ ID NO: 827 - DNA, 50 bp, Homo sapiens
agggattgtttctggaccagtttgtctaagtcctggctcttattggttca

SEQ ID NO: 828 - DNA, 50 bp, Homo sapiens
tgaactgctgctacatccagacactgtgcaaataaattatttctgctacc

SEQ ID NO: 829 - DNA, 50 bp, Homo sapiens
actatgcagtttttcttgaaggaactaaaagcaactagctccctaatggt

SEQ ID NO: 830 - DNA, 50 bp, Homo sapiens
gtctttccagcatccactctcccttgtcctcctgggggcatatctcagtc

SEQ ID NO: 831 - DNA, 50 bp, Homo sapiens
gcagtaggtaggctcacttctctttcccttcaaaatgcttttcataggct

SEQ ID NO: 832 - DNA, 50 bp, Homo sapiens
tctgctgttgggctggtgtgtggacagaaggaatggaaagccaaattaat

SEQ ID NO: 833 - DNA, 50 bp, Homo sapiens
ccacttggaataggaatatcacccctatcttggaagaccaggtggaggct

SEQ ID NO: 834 - DNA, 50 bp, Homo sapiens
gccctatggcgttgttaaacacgagcgtatgctagtaagtatcattcata

SEQ ID NO: 835 - DNA, 50 bp, Homo sapiens
gtgggtgcatggggctgtggagtgggtgtcagtatggatgtgtctgaatg

SEQ ID NO: 836 - DNA, 50 bp, Homo sapiens
cattcgtctgtatgcccagtcccatccgtgtcctgctgtaactacataga

SEQ ID NO: 837 - DNA, 50 bp, Homo sapiens
tgtctgcttcttccattttctcgtctctctcccctcttcccccattatcc

SEQ ID NO: 838 - DNA, 50 bp, Homo sapiens; identical to SEQ ID NO: 580

SEQ ID NO: 839 - DNA, 50 bp, Homo sapiens
ccagattagggtggctgtccatccctggatagctatttgcacgaatcatg

SEQ ID NO: 840 - DNA, 50 bp, Homo sapiens
cggagctctggctctgctgtaggaagcccggtacgtccttcatgacagca

SEQ ID NO: 841 - DNA, 50 bp, Homo sapiens
gcactgaatatcgaacaagcactcaaattgaagtatcagtcatgttttgt

SEQ ID NO: 842 - DNA, 50 bp, Homo sapiens
agctcgaggtgtcctgcacttttcttataaggctactgaagttacatgtt

SEQ ID NO: 843 - DNA, 50 bp, Homo sapiens
tgccattggaatgtttctacacgatcctattaagaataatgtgatgccct

SEQ ID NO: 844 - DNA, 50 bp, Homo sapiens
ggataacaagtaaatgtctgaaagcatgaggggctttatttgcctttacc

SEQ ID NO: 845 - DNA, 50 bp, Homo sapiens; identical to SEQ ID NO: 28

SEQ ID NO: 846 - DNA, 50 bp, Homo sapiens
aaaactcatctcagaagaggatctgaatggggccgcacatcaccatcatc

SEQ ID NO: 847 - DNA, 50 bp, Homo sapiens
aaacccctttaaatgagggccagtattatctctgctttcagaagtagaca

SEQ ID NO: 848 - DNA, 50 bp, Homo sapiens
gacctgactccactcttaaacctgggtcttctccttggcggtgctgtcag

SEQ ID NO: 849 - DNA, 50 bp, Homo sapiens
cttttatagcagtttatggggagcacttgaaagagcgtgtgtacatgtat

SEQ ID NO: 850 - DNA, 50 bp, Homo sapiens
agatcctgaaagtagctgcctgtgacccagtgaagccatatcaaaagtgg

SEQ ID NO: 851 - DNA, 50 bp, Homo sapiens
tactgctaagtgcttggttggggtggtgagatgatgattagatcaggggt

SEQ ID NO: 852 - DNA, 50 bp, Homo sapiens
ttgtacccagagactatgatttatattgattgcacttgcctgccatgatt

SEQ ID NO: 853 - DNA, 50 bp, Homo sapiens
tttcagatgcttctgggagacaccaaagggtgaagctatttatctgtagt

SEQ ID NO: 854 - DNA, 50 bp, Homo sapiens
ttgtggtaatatgatgtgcctttccttgcctaaatcccttcctggtgtgt

SEQ ID NO: 855 - DNA, 50 bp, Homo sapiens
cacaaggtgcgcggttaccgctacttggaggaggacaactcggacgagag

SEQ ID NO: 856 - DNA, 50 bp, Homo sapiens
tagactcacgaacaaatccacctgagatcagcagagccaccctagatcag

SEQ ID NO: 857 - DNA, 50 bp, Homo sapiens
cctcagaggcttactctaacccatcccagaataaatggagacttcatgtg

SEQ ID NO: 858 - DNA, 50 bp, Homo sapiens
aggctgttgatgcttattctctgtaactaagaattttaccttttggggga

SEQ ID NO: 859 - DNA, 50 bp, Homo sapiens
gtaaacgtatcctctgtattcagtaaacaggctgcctctccagggagggc

SEQ ID NO: 860 - DNA, 50 bp, Homo sapiens
aactaaccccctttccctgctagaaataacaattagatgccccaaagcga

SEQ ID NO: 861 - DNA, 50 bp, Homo sapiens
gcctcgacacatcctcatccccagcatgggacacctcaagatgaataata

SEQ ID NO: 862 - DNA, 48 bp, Homo sapiens
gcacagtcacattccctccttaggaatcttccccttccaccctttaca

SEQ ID NO: 863 - DNA, 50 bp, Homo sapiens
tttgaggttctttggttttgttagtaaaagccagttctgtggtgatgacc

SEQ ID NO: 864 - DNA, 50 bp, Homo sapiens
catctgaagtgtggagccttacccatttcatcacctacaacggaagtagt

SEQ ID NO: 865 - DNA, 50 bp, Homo sapiens
ttttggcagttgtctgcattaacctgttcatacacccattttgtcccttt

SEQ ID NO: 866 - DNA, 50 bp, Homo sapiens
tggtgtttatgtactactctatagaactcttggcttgcacttctacagct

SEQ ID NO: 867 - DNA, 50 bp, Homo sapiens; identical to SEQ ID NO: 131

SEQ ID NO: 868 - DNA, 50 bp, Homo sapiens
tggtctccttggaaatccgtctagttaacatttcaagggcaataccgtgt

SEQ ID NO: 869 - DNA, 50 bp, Homo sapiens
gtctaccaggcgaaaaccacagattctccttctagttagtatagcggact

SEQ ID NO: 870 - DNA, 50 bp, Homo sapiens
acttctcttgatgtagaaagagatgacgttgttaccctgagtgacagtca

SEQ ID NO: 871 - DNA, 50 bp, Homo sapiens
tgagctaagtgtcatgcatatttgtgaagaaacacccttgtttggtccct

SEQ ID NO: 872 - DNA, 50 bp, Homo sapiens
ctgagcaaggcagatgacctaatcacctcacgacagcaatacagcagtga

SEQ ID NO: 873 - DNA, 50 bp, Homo sapiens
tttgtactattgctagaccctcttctgtaatgggtaatgcgtttgattgt

SEQ ID NO: 874 - DNA, 50 bp, Homo sapiens
tgctatgctaatgtctagaaaggcatacgatgctactattatgctctgtt

SEQ ID NO: 875 - DNA, 50 bp, Homo sapiens
actgctctttctcaggcccaaggtaaaaaggtttttggtctcatgttgac

SEQ ID NO: 876 - DNA, 50 bp, Homo sapiens
tcaccagctgatgacacttccaaagagattagctcacctttctcctaggc

SEQ ID NO: 877 - DNA, 50 bp, Homo sapiens; identical to SEQ ID NO: 116

SEQ ID NO: 878 - DNA, 50 bp, Homo sapiens
tgcatgaagcactgtttttaaacccaagtaaagactgcttgaaacctgtt

SEQ ID NO: 879 - DNA, 50 bp, Homo sapiens
tgattttgcaacttaggatgtttttgagtcccatggttcattttgattgt

SEQ ID NO: 880 - DNA, 50 bp, Homo sapiens
tttgagcgatctctcacatgatggggttctttagtacatggtaacagcca

SEQ ID NO: 881 - DNA, 50 bp, Homo sapiens
cccggcctgggactcagcatttctgatatgccttaagaattcattctgtt

SEQ ID NO: 882 - DNA, 50 bp, Homo sapiens
agttttgctgaagactggccttattaatggacagctttcctaacaagaga

SEQ ID NO: 883 - DNA, 50 bp, Homo sapiens
gggtcaatagtttcccaatttcaggatatttcgatgtcagaaataacgca

SEQ ID NO: 884 - DNA, 50 bp, Homo sapiens
tgagagctgaaatgagaccatttactttgtttaaaatgctgtactgtgca

SEQ ID NO: 885 - DNA, 50 bp, Homo sapiens
ttgagctaagaccttaggaaattcactttctgcatgataaaatgacccaa

SEQ ID NO: 886 - DNA, 50 bp, Homo sapiens
tgtcattgtacactttatttccctcacactgtgttatgctctgatgtgct

SEQ ID NO: 887 - DNA, 50 bp, Homo sapiens
ggtctctttgactaatcaccaaaaagcaaccaacttagccagttttattt

SEQ ID NO: 888 - DNA, 50 bp, Homo sapiens
aggttcttcctgtacatacgtgtatatatgtgaacagtgagatggccgtt

SEQ ID NO: 889 - DNA, 50 bp, Homo sapiens
acttggatgctgccgctactgaatgtttacaaattgcttgcctgctaaag

SEQ ID NO: 890 - DNA, 50 bp, Homo sapiens
gggaggcgtggctgagaccaactggtttgcctataatttattaactattt

SEQ ID NO: 891 - DNA, 50 bp, Homo sapiens
tctcccagaatgtacttatcttacctcggcatgtactgtagtcactcagt

SEQ ID NO: 892 - DNA, 50 bp, Homo sapiens
tgtgcactgttgtaaaccattcagaattttcctgctaggcccttgatgct

SEQ ID NO: 893 - DNA, 50 bp, Homo sapiens
catcggccagacagagttgaatgcaagcaatccagaagaagtgttacagc

SEQ ID NO: 894 - DNA, 50 bp, Homo sapiens
tgctctagccatcaggttctttcaaatgcatctttacactcttgcacaaa

SEQ ID NO: 895 - DNA, 50 bp, Homo sapiens
tgagcatgaaatgggatcctgcatcacttgttttaactatttattttgcc

SEQ ID NO: 896 - DNA, 50 bp, Homo sapiens
tttgcggctagttggctattcaagaaacctcgcccctctgaatgtcatac

SEQ ID NO: 897 - DNA, 50 bp, Homo sapiens
gtttacgtggaagaaacgctaagggtttgctcccaggaaaggagaggaag

SEQ ID NO: 898 - DNA, 50 bp, Homo sapiens
tgctcaaatcaggacttaaatcataggcaccacatttttcatgtcagact

SEQ ID NO: 899 - DNA, 50 bp, Homo sapiens
tgaaattctacccatcttgagggaggaccgttcctcagttaaggacttgt

SEQ ID NO: 900 - DNA, 50 bp, Homo sapiens
atgagtgtgtcggaatcccgtgcttaaaatacgctcttaaattattttct

SEQ ID NO: 901 - DNA, 50 bp, Homo sapiens
aaatcagaactgaggtagcttagagatgtagcgatgtaagtgtcgatgtt

SEQ ID NO: 902 - DNA, 50 bp, Homo sapiens
aggctttagcaaagatggatatattggtgactgagacagaagaactggca

SEQ ID NO: 903 - DNA, 50 bp, Homo sapiens
agtgggcctaactcatgtgagcttgataactgatgaactcattgggagca

SEQ ID NO: 904 - DNA, 50 bp, Homo sapiens
aacactaacctctcccctcctggctcaagaattactccgaagtcagtctg

SEQ ID NO: 905 - DNA, 50 bp, Homo sapiens
tctgtcaggaaatgtaactttggttttatttttggcttattccaaggggt

SEQ ID NO: 906 - DNA, 50 bp, Homo sapiens
aaattgtgccggacttacctttcattgaacatgctgccataacttagatt

SEQ ID NO: 907 - DNA, 50 bp, Homo sapiens
tggcagggagctgggacctggagagacaactcctgtaaataaaacacttt

SEQ ID NO: 908 - DNA, 50 bp, Homo sapiens
agggagataatggagtccactttaatttggaattctgtgtgagctatgat

SEQ ID NO: 909 - DNA, 50 bp, Homo sapiens
agatcagtgatactggtgttagtgttgtaatcaggttaaacccacttcca

SEQ ID NO: 910 - DNA, 50 bp, Homo sapiens
ccatttgacagtaaaggctcttggcttctgttggaggcatgggaaattgt

SEQ ID NO: 911 - DNA, 50 bp, Homo sapiens
tttaacagcctgtcctcccggcatcaggagtcattgaacaatcatggatt

SEQ ID NO: 912 - DNA, 50 bp, Homo sapiens
aatacttattgtttggcaggtcatccacacacttctgcccccactgcatt

SEQ ID NO: 913 - DNA, 50 bp, Homo sapiens
ttatcagatgggatactggggactataaacaatggaaataaagccactgt

SEQ ID NO: 914 - DNA, 50 bp, Homo sapiens
ccctgtgcctttcctttgagagtgaaggtgggtggagttgaccagagaaa

SEQ ID NO: 915 - DNA, 50 bp, Homo sapiens
tgtgtgcgtagaatattacgtatgcatgttcatgtctaaagaatggctgt

SEQ ID NO: 916 - DNA, 50 bp, Homo sapiens
tctacatgtgactggctttcttgccctcgtctcttgaatgtttagactct

SEQ ID NO: 917 - DNA, 50 bp, Homo sapiens
tggtacccaaactcaccatttggtcctctttaatctttgagggtttcaat

SEQ ID NO: 918 - DNA, 50 bp, Homo sapiens
ttccatttattcatgtacattggccagttcctggtccttgtctgacttct

SEQ ID NO: 919 - DNA, 50 bp, Homo sapiens
aaccatctggagtcagtacagatcatcaatccttccacatatacaagttc

SEQ ID NO: 920 - DNA, 50 bp, Homo sapiens
ggccacctgctgactatttgtggtttaaaataaaaggtttacttgtctgc

SEQ ID NO: 921 - DNA, 50 bp, Homo sapiens
tctttgtaaagcacgatgatacaaatctggtgccagtgttatattttgca

SEQ ID NO: 922 - DNA, 50 bp, Homo sapiens
catggatatcatgtatccttcctggtgctcacacacctgtcaccttgtaa

SEQ ID NO: 923 - DNA, 50 bp, Homo sapiens
ataaggtgcataaaacccttaaattcatctagtagctgttcccccgaaca

SEQ ID NO: 924 - DNA, 50 bp, Homo sapiens
tggaccggagtctgctgagtttataaggttccaaaaatatggtaaaatct

SEQ ID NO: 925 - DNA, 50 bp, Homo sapiens
actcgaccttggtaaacggaaatgttgggggtgaagagaaacaatcacta

SEQ ID NO: 926 - DNA, 50 bp, Homo sapiens
ttcaaggttctgcgaaattaattgggcaggttaattgtgtacctgaaact

SEQ ID NO: 927 - DNA, 50 bp, Homo sapiens
tccccaggatggggcctcatacaacccttcatctgcactcaacatttaat

SEQ ID NO: 928 - DNA, 50 bp, Homo sapiens
ttttagacatggagtgcaggtggacactgtgtgaactgtttttggtcagt

SEQ ID NO: 929 - DNA, 50 bp, Homo sapiens
caagaaacttggtctgcagtctggaagcttgtctgctctatagaaatgaa

SEQ ID NO: 930 - DNA, 50 bp, Homo sapiens; identical to SEQ ID NO: 929

SEQ ID NO: 931 - DNA, 50 bp, Homo sapiens; identical to SEQ ID NO: 602

SEQ ID NO: 932 - DNA, 50 bp, Homo sapiens
ccccttcaactgagggtcattttaccagagtcaataaaggccaacccttc

SEQ ID NO: 933 - DNA, 50 bp, Homo sapiens
attctgagggtgactgaggctacagctgctatcacatgccgaactttctt

SEQ ID NO: 934 - DNA, 50 bp, Homo sapiens
tggtatcaggagttgggatttctcagcactgctaatgaagatcccctctt

SEQ ID NO: 935 - DNA, 50 bp, Homo sapiens
cgcagagaggagaaaaggagacagcaagacgccaataaagaaacacaact

SEQ ID NO: 936 - DNA, 50 bp, Homo sapiens
cccgcacgggcagctgaaggccgctgttttctaatatttgtattctaatt

SEQ ID NO: 937 - DNA, 50 bp, Homo sapiens
cccctgggagatgtagcaaattgagtgtgggttttggagtctgagcctca

SEQ ID NO: 938 - DNA, 50 bp, Homo sapiens
gcagagggagggttgccatgaaggaacttgggattttcaatggaataaat

SEQ ID NO: 939 - DNA, 50 bp, Homo sapiens
cctttcacgtctggacgaattaccaaatgccatgaattgccactgtgtgt

SEQ ID NO: 940 - DNA, 50 bp, Homo sapiens
aggaagatggcgctgttatcagcggggaaatgtactatttaagatcagct

SEQ ID NO: 941 - DNA, 50 bp, Homo sapiens
atccaagtctgaaactctgcgctctagtactgctgttaagatacacaact

SEQ ID NO: 942 - DNA, 50 bp, Homo sapiens
tggatagccatttctgctcaaccacacattctctaagaaacagcttgaaa

SEQ ID NO: 943 - DNA, 50 bp, Homo sapiens
tgttgtatgtggatggggaagttttgtttctcctcttagcatttgtttct

SEQ ID NO: 944 - DNA, 50 bp, Homo sapiens
tctgaatgatcctactcctttggagtaaaactagtgcttaccagtttcca

SEQ ID NO: 945 - DNA, 50 bp, Homo sapiens
tccttttgtagccactttgagtctgcagttgtcagtaagcctttttaaag

SEQ ID NO: 946 - DNA, 50 bp, Homo sapiens
gggggaaattaccagtagaatgccttggtctgaatatttgatagaaccaa

SEQ ID NO: 947 - DNA, 50 bp, Homo sapiens
ctggtactttacagttttgcaccaactctgccaagccactggatcttaca

SEQ ID NO: 948 - DNA, 50 bp, Homo sapiens
atccagtcactcatcaagtgtaatctgtctcctaaatatctctggaacct

SEQ ID NO: 949 - DNA, 50 bp, Homo sapiens
agcttttggggtcagatctctggaacatcatgtgatgaagctgacatttt

SEQ ID NO: 950 - DNA, 50 bp, Homo sapiens
agcagttaggcttgactttgaggagaggctgtgatgtttatgatccctga

SEQ ID NO: 951 - DNA, 50 bp, Homo sapiens
gctgtccacagaaaacgcccttaagtagccctaccttactccttagagct

SEQ ID NO: 952 - DNA, 50 bp, Homo sapiens
catgggtattaatagtctttgctgctggtaatactgaaagaacctgcttt

SEQ ID NO: 953 - DNA, 50 bp, Homo sapiens
aggatttgatttcttgaaaccctctaggtctctagaacactgaggacagt

SEQ ID NO: 954 - DNA, 50 bp, Homo sapiens
ggactcaggagctaatactgtctacagtggagcttggtgcaattagaagc

SEQ ID NO: 955 - DNA, 50 bp, Homo sapiens
accaggaggacagagtttgctttcatattttccctgtaagtaagagggct

SEQ ID NO: 956 - DNA, 50 bp, Homo sapiens
ccatgaagaagcaagacgaaaacacacaggagggaaaatcctgggattct

SEQ ID NO: 957 - DNA, 50 bp, Homo sapiens
ttggaatttgtgttgcatgtaaggcaatctttcctgttgtaaatcttcct

SEQ ID NO: 958 - DNA, 50 bp, Homo sapiens
aggaaactgagtagactcctgtgtaaccctgtttggaactttgccttctt

SEQ ID NO: 959 - DNA, 50 bp, Homo sapiens
tttacaaggcagaatggggtgtaacagttgaattaaactagcaatcacgt

SEQ ID NO: 960 - DNA, 50 bp, Homo sapiens
tagtaggaatgaagtggaagtccaggcttggattgcctaactacactgct

SEQ ID NO: 961 - DNA, 50 bp, Homo sapiens
agtgtttagtctcatgttgggaacacatgaatgtgatgaacatagtgaat

SEQ ID NO: 962 - DNA, 50 bp, Homo sapiens
accctttgagagttccacaagtggtagtagagtggtttaacgtctttcct

SEQ ID NO: 963 - DNA, 50 bp, Homo sapiens
ttgccccttttctgtaagtctcttgggatcctgtgtagaagctgttctca

SEQ ID NO: 964 - DNA, 50 bp, Homo sapiens
actcatcaattgaaaagtcctccaaaaagagaactattgggaaaccatgg

SEQ ID NO: 965 - DNA, 50 bp, Homo sapiens; identical to SEQ ID NO: 21

SEQ ID NO: 966 - DNA, 50 bp, Homo sapiens
tcagacctggttgattttgtactttggaactgtaccttggatggttttgt

SEQ ID NO: 967 - DNA, 50 bp, Homo sapiens
gtatctcatggcctcttgatgtggaaagaagttgacagagggttgcaggg

SEQ ID NO: 968 - DNA, 50 bp, Homo sapiens
agttcagtgagaagaaaccagaacacttgttcctagtgttgtgttgtttt

SEQ ID NO: 969 - DNA, 50 bp, Homo sapiens
gcagatggctatgtgctagagggcaaagagttggagttctatcttaggaa

SEQ ID NO: 970 - DNA, 50 bp, Homo sapiens
ttggtgtcaatgatctggtgacaataggattacattggagccaattgaat

SEQ ID NO: 971 - DNA, 50 bp, Homo sapiens
aactagaagatgtacttcgacagcatccattttacttcaaggcagcaaga

SEQ ID NO: 972 - DNA, 50 bp, Homo sapiens
atacacttttccaaatttgtcccaacagccctgtaagccagctttcttct

SEQ ID NO: 973 - DNA, 50 bp, Homo sapiens
gcattttcttcacttgcaggcaaacttggctctcaataaacttttaccac

SEQ ID NO: 974 - DNA, 50 bp, Homo sapiens; identical to SEQ ID NO: 129

SEQ ID NO: 975 - DNA, 50 bp, Homo sapiens
agccaaatgtgtcatacatcaaatcttcagcagcttttgcataatccagg

SEQ ID NO: 976 - DNA, 50 bp, Homo sapiens
tcctcaaaggggaaaactatgaaggggaagaagacaaacctaagatacca

SEQ ID NO: 977 - DNA, 50 bp, Homo sapiens
agatggactggagctttttctttgtgaatagaaactggatgccacagtga

SEQ ID NO: 978 - DNA, 50 bp, Homo sapiens
agttgtcagaagactcctgggtgtacagagcaaatcaagctgcatcagta

SEQ ID NO: 979 - DNA, 50 bp, Homo sapiens
agtggcttcatagctactgacaaatgtctgaactattgtcgtgcccttca

SEQ ID NO: 980 - DNA, 50 bp, Homo sapiens
gcctgtacaaacattcaagttagttggcagtctataaatgtgagttgggt

SEQ ID NO: 981 - DNA, 50 bp, Homo sapiens
aaggaaggtaaagttaggggactagaagactctaaattggcttctacaga

SEQ ID NO: 982 - DNA, 50 bp, Homo sapiens
agaactaattgcccatgtttaattatagcagacacgccattctaacaggt

SEQ ID NO: 983 - DNA, 50 bp, Homo sapiens
aacttggtattgttgtagtttatgtagtaagtgacttggcacccatcaga

SEQ ID NO: 984 - DNA, 50 bp, Homo sapiens
agtttaacttttcctcacccctgtatagaaaatgccttgcctctcaagag

SEQ ID NO: 985 - DNA, 50 bp, Homo sapiens
gtcttgggctggatgggttatagagctgagcggctgtgatggttctgttt

SEQ ID NO: 986 - DNA, 50 bp, Homo sapiens
gacacatctagaatgtttttctttcaccgtacctccaaaagaggcaattt

SEQ ID NO: 987 - DNA, 50 bp, Homo sapiens
accagggatgctctctaacgtaatcaagggaaggttcagtaagacaaagt

SEQ ID NO: 988 - DNA, 50 bp, Homo sapiens
acacagttcagtttttgagggaactagttttgtcataatactacacccct

SEQ ID NO: 989 - DNA, 50 bp, Homo sapiens
tgcagtgggaattcttgagtgaggtcttacctcttctttaaacctcttca

SEQ ID NO: 990 - DNA, 50 bp, Homo sapiens
aaggcagaatagaatgctgagattggttaagtttgcaatgaccatcttga

SEQ ID NO: 991 - DNA, 50 bp, Homo sapiens
tgccctaatcttgagttgaggaaatatatgcacaggagtcaaagagatgt

SEQ ID NO: 992 - DNA, 50 bp, Homo sapiens
gctagattgtgaagtacatgggatttcatgagccagaggaggcatttgga

SEQ ID NO: 993 - DNA, 50 bp, Homo sapiens
gcctcaaagaaaacccagagtgccctgttctaaaacgtagttctgaatcc

SEQ ID NO: 994 - DNA, 50 bp, Homo sapiens
aatcccagggcttggttaagtgctgtgtgataacttgtttggatgagact

SEQ ID NO: 995 - DNA, 50 bp, Homo sapiens
aggtttcttacccaacacaaatggacagtggatttgactttctaaagact

SEQ ID NO: 996 - DNA, 50 bp, Homo sapiens
cctggtgatgggaagggtcttgtgttttaatgccaataaatgtgccagct

SEQ ID NO: 997 - DNA, 50 bp, Homo sapiens
aaaatattgagccaggccctggggaagtgggaagtgagagccagagcggc

SEQ ID NO: 998 - DNA, 50 bp, Homo sapiens
agcacacaaggaatcccagaaaatgttggctgaaggaataaatggatgga

SEQ ID NO: 999 - DNA, 50 bp, Homo sapiens
cactgcctaccgccattcatgattaaaccatccagaaataccatccctgt

SEQ ID NO: 1000 - DNA, 50 bp, Homo sapiens
aaatgagatggcctctgcggacacatgaaagggtacttcagcttaccaaa

SEQ ID NO: 1001 - DNA, 50 bp, Homo sapiens
tggactaggagagacttgattttggtgctaaagttccccagttcatatgt

SEQ ID NO: 1002 - DNA, 50 bp, Homo sapiens
ctcacagccagcacgacccccagaaagaggcgtcccacaataaacacgtc

SEQ ID NO: 1003 - DNA, 50 bp, Homo sapiens
acagaacattgagatgtgcctagttccgtatttacagtttggtctggctg

SEQ ID NO: 1004 - DNA, 50 bp, Homo sapiens
tgaatttcagatgggtgatttaagtgagtcacaagtcacaaaactttgct

SEQ ID NO: 1005 - DNA, 50 bp, Homo sapiens
tgtacttaagtgctgatgactgttagccagtttacaactttttaccatcg

SEQ ID NO: 1006 - DNA, 50 bp, Homo sapiens
ttctgaacattttagtcaagctacaacaggtttggaaaacctctgtgggg

SEQ ID NO: 1007 - DNA, 50 bp, Homo sapiens
tgtcaagggcattaaaagcctcctgaagcataatcttatcaaagggatac

SEQ ID NO: 1008 - DNA, 50 bp, Homo sapiens
tcagtccatctcaagacctgtgcctgtcagatttcacaattatggagatt

SEQ ID NO: 1009 - DNA, 50 bp, Homo sapiens
ggtaggagtgaaatctctctctcaaactctaggaaagcccgagtcatact

SEQ ID NO: 1010 - DNA, 50 bp, Homo sapiens
acagcaggtgtcatgggtcaagcataaatcatatatagcattttcaggca

SEQ ID NO: 1011 - DNA, 50 bp, Homo sapiens; identical to SEQ ID NO: 1010

SEQ ID NO: 1012 - DNA, 50 bp, Homo sapiens
tgtgggtccctatgagtgtagagcccatatccccatagagtctacctaga

SEQ ID NO: 1013 - DNA, 50 bp, Homo sapiens
tgttttcatttcagaacattgtgctgtctgtcagcatatgtatatcagct

SEQ ID NO: 1014 - DNA, 50 bp, Homo sapiens
tggctactgcaaaaccagttttgacaggtcagattttcatatgtataggt

SEQ ID NO: 1015 - DNA, 50 bp, Homo sapiens
agaggttctgaaaggtctgtgtcttgtcaaaacaagtaaacggtggaact

SEQ ID NO: 1016 - DNA, 50 bp, Homo sapiens
atgcgtcctggttttcaatcgctgctgaacaaacctatcaaaaatgtagc

SEQ ID NO: 1017 - DNA, 50 bp, Homo sapiens
agtatgatccctcaaaacctcactaactggaaggatgattttgtctcagt

SEQ ID NO: 1018 - DNA, 50 bp, Homo sapiens
gagggttcctcactgaggttgagaggtgtgttggataggactgatcccac

SEQ ID NO: 1019 - DNA, 50 bp, Homo sapiens
aagtgtggttcctgaaggctgtctttgtaactttttgtagttctttgtgt

SEQ ID NO: 1020 - DNA, 50 bp, Homo sapiens; identical to SEQ ID NO: 798

SEQ ID NO: 1021 - DNA, 50 bp, Homo sapiens
ctggaaagggggctaagatcagggccttcattctggatcaggcgaaattt

SEQ ID NO: 1022 - DNA, 50 bp, Homo sapiens
gttcctcttcgggaagcttttgataaggaattctcagaccgatagggtgt

SEQ ID NO: 1023 - DNA, 50 bp, Homo sapiens
agttttgtacttttcacatagcttgttgccccgtaaaagggttaacagca

SEQ ID NO: 1024 - DNA, 50 bp, Homo sapiens
ttggatctggttctgaggaggacacacctggcatcggatgacctttataa

SEQ ID NO: 1025 - DNA, 50 bp, Homo sapiens
tagacatgcttgtgtccacacagcacaccaatgtgatacttccactgacc

SEQ ID NO: 1026 - DNA, 50 bp, Homo sapiens
atgggatgcggtgggttgcccaataaacggctgtggagtggaaattcctc

SEQ ID NO: 1027 - DNA, 50 bp, Homo sapiens
tttgtacgtagctgttacatgtagggcaatctgtctttaagtagggataa

SEQ ID NO: 1028 - DNA, 50 bp, Homo sapiens; identical to SEQ ID NO: 38

SEQ ID NO: 1029 - DNA, 50 bp, Homo sapiens
gagatgagttttgttattttggggttttcaagcattggaaccaaaggcca

SEQ ID NO: 1030 - DNA, 50 bp, Homo sapiens
tcacttagacccctgtaacaggttaaatcttcatggtgttctgtttccta

SEQ ID NO: 1031 - DNA, 50 bp, Homo sapiens
gctctccagactgttacagtgcatgagtgataataaaaatgagtcagtca

SEQ ID NO: 1032 - DNA, 50 bp, Homo sapiens
ggaggtaaacattggagatgtttgtgaaaatattactcttgctgtgaggt

SEQ ID NO: 1033 - DNA, 50 bp, Homo sapiens
ggcccctttctttcttctgaggattgcagaggatatagttatcaatctct

SEQ ID NO: 1034 - DNA, 50 bp, Homo sapiens
tcaacagcacttaaactgaagtttgggttgctcatacaataaacagattg

SEQ ID NO: 1035 - DNA, 50 bp, Homo sapiens
gggccattttatgatgcattgcacaccctctggggaaattgatctttaaa

SEQ ID NO: 1036 - DNA, 50 bp, Homo sapiens
ttttccacaggggacctacccctattgcggtcctccagctcatctttcac

SEQ ID NO: 1037 - DNA, 50 bp, Homo sapiens
gggtgagaacacttgcaacagtttattaatgaggtgactttcaccttagg

SEQ ID NO: 1038 - DNA, 50 bp, Homo sapiens
aatgtaccatcaataaaattggctgcttgggcagttttagttaccacctt

SEQ ID NO: 1039 - DNA, 50 bp, Homo sapiens
ttttcagaggcttcctaattaatcttgccctcctccatttcagtccattt

SEQ ID NO: 1040 - DNA, 50 bp, Homo sapiens
agctccaaccttacgatggagaattaaacttgcttgtatttccactttgt

SEQ ID NO: 1041 - DNA, 50 bp, Homo sapiens
agcttcctcttcctcaggacagcttctactttagatgatccaataatgat

SEQ ID NO: 1042 - DNA, 50 bp, Homo sapiens
cactgacttctattccatgagctttttcaaggcgcttattttatggcagc

SEQ ID NO: 1043 - DNA, 50 bp, Homo sapiens
tgtttcgtaaattaaataggtctggcccagaagacccactcaattgcctt

SEQ ID NO: 1044 - DNA, 50 bp, Homo sapiens
ggaagacccaaggaaatccggaatttcgcaccagaggacccaccacgtcc

SEQ ID NO: 1045 - DNA, 50 bp, Homo sapiens
tcttgttacttccaaggagaaccaagaatggctctgtcacactcgaagcc

SEQ ID NO: 1046 - DNA, 50 bp, Homo sapiens
tctttctctaaagcttgtttgatgaaactggttggtcctttcagtgaaca

SEQ ID NO: 1047 - DNA, 50 bp, Homo sapiens
gctgtgtgacttagtagataaaatactgccttctgcctttgggaccatga

SEQ ID NO: 1048 - DNA, 50 bp, Homo sapiens
tctgtaattggacagctctctcgaagagatcttacagactgtatcagtct

SEQ ID NO: 1049 - DNA, 50 bp, Homo sapiens
ggtcgtggacgtggtcagccacctcagtaaaattggagaggattcttttg

SEQ ID NO: 1050 - DNA, 50 bp, Homo sapiens
aaagtgaaaccaagagtacaagagacaggtgaaattaaagagccccttga

SEQ ID NO: 1051 - DNA, 50 bp, Homo sapiens
gtccaggatgcagagctaaaggccctcctccagagttctacaagtcgaaa

SEQ ID NO: 1052 - DNA, 50 bp, Homo sapiens
ccaacttgagatgtatgaaggcttttggtctccctgggagtgggtggagg

SEQ ID NO: 1053 - DNA, 50 bp, Homo sapiens
ttcctcatcccatttacagtttttctaactccagggtagtgtttagtgtt

SEQ ID NO: 1054 - DNA, 50 bp, Homo sapiens
catgccaaagactcaactgctttcaaagataatgtgggtgctagatgcag

SEQ ID NO: 1055 - DNA, 50 bp, Homo sapiens
tccccttctcccctgcactgtaaaatgtgggattatgggtcacaggaaaa

SEQ ID NO: 1056 - DNA, 50 bp, Homo sapiens
accatgcatagagtcaatcaaatccttgtgatgttttgtatggactttga

SEQ ID NO: 1057 - DNA, 50 bp, Homo sapiens
tgtgctgcctcaagactgctggagtcaggacattttatagagccttttcc

SEQ ID NO: 1058 - DNA, 50 bp, Homo sapiens
gtgcagtctcttagcagacttcaggcccaaactgtattcttcactcaggc

SEQ ID NO: 1059 - DNA, 50 bp, Homo sapiens
gttagtgaaagctgtttactgtaacggggaaaaccagattctttgcatct

SEQ ID NO: 1060 - DNA, 50 bp, Homo sapiens
gcttctgtaaatgccatcccaatgtggtttggttttgttgaacagaaacc

SEQ ID NO: 1061 - DNA, 50 bp, Homo sapiens
ttgcctcgataagtttccaagtcactgaaatctgctgaaggttttactgt

SEQ ID NO: 1062 - DNA, 50 bp, Homo sapiens
acttctgaactgaggaatttgctgttgacagccaaagtatagtgtacaag

SEQ ID NO: 1063 - DNA, 50 bp, Homo sapiens
agagccatctggtgtgaagaactctatatttgtatgttgagagggcatgg

SEQ ID NO: 1064 - DNA, 50 bp, Homo sapiens
agaacaagtttgccttgattttgtttaaaatgacttctgctaagcaccca

SEQ ID NO: 1065 - DNA, 50 bp, Homo sapiens
cctgccaaagcaagaagaaggcttggtccccagaaacaaacagtagtcat

SEQ ID NO: 1066 - DNA, 50 bp, Homo sapiens
ggagtctcaggccaaggatgtcattgaagagtatttcaaatgcaagaaat

SEQ ID NO: 1067 - DNA, 50 bp, Homo sapiens; identical to SEQ ID NO: 1066

SEQ ID NO: 1068 - DNA, 50 bp, Homo sapiens
tttcatctgaatccagaggtgcatcaaattaaatgacagctccacttggc

SEQ ID NO: 1069 - DNA, 50 bp, Homo sapiens
ttgacacgttccacttcctttgcaattattgtatttagttgtgcactagt

SEQ ID NO: 1070 - DNA, 50 bp, Homo sapiens
ccaaatcaactgtgtgaactgtttctgcactgcttgctaatggtttcatc

SEQ ID NO: 1071 - DNA, 50 bp, Homo sapiens
attgagacgggaaaaactcgctgtaaaataatgccaacctagataatgct

SEQ ID NO: 1072 - DNA, 50 bp, Homo sapiens
tgttcttgcattgcatttaatgatcccttttctccccacctccacacact

SEQ ID NO: 1073 - DNA, 50 bp, Homo sapiens
tgcagattcctagtagcatgccttacctacagcactatgtgcatttgctg

SEQ ID NO: 1074 - DNA, 50 bp, Homo sapiens
gcaagaccgtttgtccacttcattttgtataatcacagttgtgttcctga

SEQ ID NO: 1075 - DNA, 50 bp, Homo sapiens
aatttaacttttgggtgccaggaaatgggttttctcaaagtccattgccg

SEQ ID NO: 1076 - DNA, 50 bp, Homo sapiens
tcgtggaagggagagccatcagcagaaagagaccctgagatcttcgcctg

SEQ ID NO: 1077 - DNA, 50 bp, Homo sapiens
aaacacaccagggagacaccataaaacagaccaagactaacttaaaaaca

SEQ ID NO: 1078 - DNA, 50 bp, Homo sapiens
aaccacaatcaaacatataaataagcctggaaaaccaactacaaccagca

SEQ ID NO: 1079 - DNA, 50 bp, Homo sapiens
tttcctgattatttgatgctagctggaattcaagaaatggcattgacctt

SEQ ID NO: 1080 - DNA, 50 bp, Homo sapiens
tcaccccaagtagcatgactgatctgcaatttaaaattcctgtgatctgt

SEQ ID NO: 1081 - DNA, 50 bp, Homo sapiens
tgagaagtgcggaataggttgcttctaccacctgttcttaatgtaacagt

SEQ ID NO: 1082 - DNA, 50 bp, Homo sapiens
tcgaatgagtggtcaggtagtcttaaagagcctcatgttaaatagacaca

SEQ ID NO: 1083 - DNA, 50 bp, Homo sapiens
tgaagtgcaaataaaagcactgctactataagacattctggaatggttgt

SEQ ID NO: 1084 - DNA, 50 bp, Homo sapiens
gcagtccccagatccagaacatgggaagttagggaaaatgtgtgattttg

SEQ ID NO: 1085 - DNA, 50 bp, Homo sapiens
aggtatgacaggaactgtcttcatgtccttacccaagcaagtcatccatg

SEQ ID NO: 1086 - DNA, 50 bp, Homo sapiens
aattttgaatttctccttgccacgttaataaagccaaaagcagcgggtgc

SEQ ID NO: 1087 - DNA, 50 bp, Homo sapiens
tgactctgtgctggcaaaaatgcttgaaacctctatatttctttcgttca

SEQ ID NO: 1088 - DNA, 50 bp, Homo sapiens
gctctcccacagaaacctttgtccttgcaactttatcctttgtcccgatt

SEQ ID NO: 1089 - DNA, 50 bp, Homo sapiens
ttgccttagccagtgtacctcctacctcagtctatgtgagaggaagagaa

SEQ ID NO: 1090 - DNA, 50 bp, Homo sapiens
actgtattgggattgtaaagaacatctctgcactcagacagtttacagaa

SEQ ID NO: 1091 - DNA, 50 bp, Homo sapiens
gtgtgtgtgcatgtgtgtgttagcagaggtattttactcagaaaataggt

SEQ ID NO: 1092 - DNA, 50 bp, Homo sapiens
gccagtcaaaaagtaaaatgaagagaggcacgccaaccactccaaaattt

SEQ ID NO: 1093 - DNA, 50 bp, Homo sapiens
cactttgtggtcgaaaggctcagcctctctacatgaagtctgtggacatg

SEQ ID NO: 1094 - DNA, 50 bp, Homo sapiens
aggctttcttgtctcagcaactttcccatcttgtctctcttggatgatgt

SEQ ID NO: 1095 - DNA, 50 bp, Homo sapiens
tttttctttttgaagcatggaaaacaaatcttttatgccactccagccat

SEQ ID NO: 1096 - DNA, 50 bp, Homo sapiens
ccatgatataaggaagggccgtgcctcatggaaaagcaacaggtggcctc

SEQ ID NO: 1097 - DNA, 50 bp, Homo sapiens
taaaggcgagcaccgtcaggagcgcagagatcggccctactagatgcaga

SEQ ID NO: 1098 - DNA, 50 bp, Homo sapiens
tgagcctgacacctgtgtttcagcatttggagacatccccatgttattct

SEQ ID NO: 1099 - DNA, 50 bp, Homo sapiens
ctgagccacatccaagcctggtttgctgcactctattgccaaagactgac

SEQ ID NO: 1100 - DNA, 50 bp, Homo sapiens
acttgcctcattctcatcatccaaactgaacatttgtatcccaagcagaa

SEQ ID NO: 1101 - DNA, 50 bp, Homo sapiens
gtatgaagaaggaagcccagcagagcaggaggcagcagcaacaatgagag

SEQ ID NO: 1102 - DNA, 50 bp, Homo sapiens
ctgtgtgtgtccatgtctgcaagcagttcttcaataaatggcctgcctcc

SEQ ID NO: 1103 - DNA, 50 bp, Homo sapiens
tcaaagcagagcacagagttatttggtgtttgctgaagacagcctttgtg

SEQ ID NO: 1104 - DNA, 50 bp, Homo sapiens
acttccatctcagctaatgcacccaccagctcaaacacaccaataaagct

SEQ ID NO: 1105 - DNA, 50 bp, Homo sapiens
tgcaatccacaatctgacattctcaggaagcccccaagttgatatttcta

SEQ ID NO: 1106 - DNA, 50 bp, Homo sapiens
cagaaaccaatactgctgtgcactgagaataaaaactcatgcccccttgt

SEQ ID NO: 1107 - DNA, 50 bp, Homo sapiens
caccagtgaggattactgatgtggacagttgatggggtttgtttctgtat

SEQ ID NO: 1108 - DNA, 50 bp, Homo sapiens; identical to SEQ ID NO: 500

SEQ ID NO: 1109 - DNA, 50 bp, Homo sapiens
taaggggtagacaagataccgaataatctccacaagtttatttgtggtct

SEQ ID NO: 1110 - DNA, 50 bp, Homo sapiens
acatcaacagtggtgctgtggaatgcccagccagttaagcacaaaggaaa

SEQ ID NO: 1111 - DNA, 50 bp, Homo sapiens
acaaacaatgcaaccaactatccaagtgttataccaactaaaacccccaa

SEQ ID NO: 1112 - DNA, 50 bp, Homo sapiens
ttcacctacaaaatttcacctgcaaaccttaaacctgcaaaattttcctt

SEQ ID NO: 1113 - DNA, 50 bp, Homo sapiens
gggtacttctccataaggcatctcagtcaaatccccatcactgtcataaa

SEQ ID NO: 1114 - DNA, 50 bp, Homo sapiens
cttgctgttttccctgtccacatccatgctgtacagacaccaccattgaa

SEQ ID NO: 1115 - DNA, 50 bp, Homo sapiens
aagtcaattcctggaatttgaaagagcaaataaagacctgagaaccttcc

SEQ ID NO: 1116 - DNA, 50 bp, Homo sapiens
aagctactgtgtgtgtgaatgaacactcttgctttattccagaatgctgt

SEQ ID NO: 1117 - DNA, 50 bp, Homo sapiens
tgtcatgctcccagaatttcagcttcagcttaactgacagatgttaaagc

SEQ ID NO: 1118 - DNA, 50 bp, Homo sapiens
aggtggtactcaagccatgctgcctccttacatcctttttggaacagagc

SEQ ID NO: 1119 - DNA, 50 bp, Homo sapiens; identical to SEQ ID NO: 75

SEQ ID NO: 1120 - DNA, 50 bp, Homo sapiens
tgtggttaggaagcaatttcccaatgtacctataagaaatgtgcatcaag

SEQ ID NO: 1121 - DNA, 50 bp, Homo sapiens
gcctgcgttgccacttgtcttaactctgaatatttcatttcaaaggtgct

SEQ ID NO: 1122 - DNA, 50 bp, Homo sapiens
agctaatattgctgcaatggctggcaggaaacaggtgatcaagagtgtca

SEQ ID NO: 1123 - DNA, 50 bp, Homo sapiens
tcgaccccagaggtgaatgtattgttattattgttttgttgttgttgtga

SEQ ID NO: 1124 - DNA, 50 bp, Homo sapiens
tccttggcagctgtattctggagtctggatgttgctctctaaagaccttt

SEQ ID NO: 1125 - DNA, 50 bp, Homo sapiens
tttgccatgtccagtacagaataatttgtacttagtatttgcagcagggt

SEQ ID NO: 1126 - DNA, 50 bp, Homo sapiens
tagagaacctatagcatcttctcattcccatgtggaacaggatgcccaca

SEQ ID NO: 1127 - DNA, 50 bp, Homo sapiens
aactcatgtgcaggtttgataaacaccagaacagaagacagtgatgctgt

SEQ ID NO: 1128 - DNA, 50 bp, Homo sapiens
tggccctgacagtattcattatttcagataattccctgtgataggacaac

SEQ ID NO: 1129 - DNA, 50 bp, Homo sapiens
acctggagagagaaggtattgaaacatctcctttatgtgtgactttccca

SEQ ID NO: 1130 - DNA, 50 bp, Homo sapiens
agaaatacccactaacaaagaacaagcattagttttggctgtcatcaact

SEQ ID NO: 1131 - DNA, 50 bp, Homo sapiens
atgggcaaattcttaggtaagacaaaaacacagccccaagggcaggtagt

SEQ ID NO: 1132 - DNA, 50 bp, Homo sapiens
gctgatgccactacccgatttgtttatttgcaatttgagccatttaaaga

SEQ ID NO: 1133 - DNA, 50 bp, Homo sapiens
cctgttcccttcagccaacccgtttctgcagtaaaattaagcctgtcaaa

SEQ ID NO: 1134 - DNA, 50 bp, Homo sapiens
tggcttaaaccagtgttcagtctggtgccaaacttcgaatggaatacaaa

SEQ ID NO: 1135 - DNA, 50 bp, Homo sapiens
tgtgagttgtgaccatgtaacatgagaggttttgctagggcctattattt

SEQ ID NO: 1136 - DNA, 50 bp, Homo sapiens
agctgagtaattctaatctcttctgtgttttccttgccttaaccacaaat

SEQ ID NO: 1137 - DNA, 50 bp, Homo sapiens
aatttgctagaatccagtaaatcattttggtagctctggctgtgctatca

SEQ ID NO: 1138 - DNA, 50 bp, Homo sapiens
tggctcgaagtttctctagtgttttctgtggaaggaataaaaatttgagt

SEQ ID NO: 1139 - DNA, 50 bp, Homo sapiens
actcttgggagtgctgcagtctttaatcatgctgtttaaactgttgtggc

SEQ ID NO: 1140 - DNA, 50 bp, Homo sapiens
tttacatgattggaccctcagattctgttaaccaaaattgcagaatgggg

SEQ ID NO: 1141 - DNA, 50 bp, Homo sapiens
tgaaatcaaagcacggtgcagaacttgtaccaagtacaaaaggtccatgt

SEQ ID NO: 1142 - DNA, 50 bp, Homo sapiens
ccttactctgtccttgatggaggggagaagggagggcaaagaagttaaat

SEQ ID NO: 1143 - DNA, 50 bp, Homo sapiens
caccgccatgcaactccatgcctatttactggaaacctgttatgccaaac

SEQ ID NO: 1144 - DNA, 50 bp, Homo sapiens
caagagaatgaaggaggctaaggagaagcgccaggaacaaattgcgaaga

SEQ ID NO: 1145 - DNA, 50 bp, Homo sapiens
agtctcgggtatgctgttgtgaaattgaaactgtaaaagtagatggttga

SEQ ID NO: 1146 - DNA, 50 bp, Homo sapiens
actaaactacccgaaggacttaggtgctttgtgtacttaaccccaggacc

SEQ ID NO: 1147 - DNA, 50 bp, Homo sapiens
gccaccactgtctgtttgagactccttcatgagcaaagattgatgtatgg

SEQ ID NO: 1148 - DNA, 50 bp, Homo sapiens
atgaatttgaagacatggtggctgaaaagcggctcatcccagatggttgt

SEQ ID NO: 1149 - DNA, 50 bp, Homo sapiens
agcttcagtctctactggattagccctactctttcctttcccctccatta

SEQ ID NO: 1150 - DNA, 50 bp, Homo sapiens
agatgtggttatcacaagtctcgagggggaaactactgcataaaataact

SEQ ID NO: 1151 - DNA, 50 bp, Homo sapiens
tcagtaaaaatgcctgttgtgagatgaacctcctgtaacttctatctgtt

SEQ ID NO: 1152 - DNA, 50 bp, Homo sapiens
agttaactgcggagccaagagttggactataattaaattaccttccttgt

SEQ ID NO: 1153 - DNA, 50 bp, Homo sapiens
ccggtttgggttgttaatggttgaaaacttagaggaacatagtgaggcct

SEQ ID NO: 1154 - DNA, 50 bp, Homo sapiens; identical to SEQ ID NO: 1153

SEQ ID NO: 1155 - DNA, 50 bp, Homo sapiens
ccagtgatttgattaactcagggcaaggctgaatatcagagtgtatcgca

SEQ ID NO: 1156 - DNA, 50 bp, Homo sapiens; identical to SEQ ID NO: 386

SEQ ID NO: 1157 - DNA, 50 bp, Homo sapiens
actggacatcgccctacgcaacctcctcgccatgactgataagttccttt

SEQ ID NO: 1158 - DNA, 50 bp, Homo sapiens
actgctggtagcatttatctgacttggaaagttggagaagaggcattcct

SEQ ID NO: 1159 - DNA, 50 bp, Homo sapiens
cttccgaagagaagaggctggggctgtaactggaaaggggaagcgcacag

SEQ ID NO: 1160 - DNA, 50 bp, Homo sapiens
cctgaccttgagctctagtctcccctttaaatcttaccttggcagtaaca

SEQ ID NO: 1161 - DNA, 50 bp, Homo sapiens
ttggtcccacagtttttatgtgtcctacttgaaattatgtttgctcccgt

SEQ ID NO: 1162 - DNA, 50 bp, Homo sapiens
tggaggatttttgttaagtcaagtgtcaatcgaagttaaaaagcaagggt

SEQ ID NO: 1163 - DNA, 50 bp, Homo sapiens
atggctcttttcctattagagcaacttgtgtttccctgataatgtgtaca

SEQ ID NO: 1164 - DNA, 50 bp, Homo sapiens
gtcgtgactgacttggtgtgttgctattgtgtttctatatactccgtcca

SEQ ID NO: 1165 - DNA, 50 bp, Homo sapiens
tttagtccagtggtttccacagctggctaagccaggagtcacttggaggc

SEQ ID NO: 1166 - DNA, 50 bp, Homo sapiens
tggaagacagtaaagaacagccctctgtagtcagtaaagtttcaccttct

SEQ ID NO: 1167 - DNA, 50 bp, Homo sapiens
tgggtggagtattatgtttaactggagttgtcaagtatgagtccctcagg

SEQ ID NO: 1168 - DNA, 50 bp, Homo sapiens
aaagtagtaaatcgggctgtcttaatagtgcgcctgttactaatggaatt

SEQ ID NO: 1169 - DNA, 50 bp, Homo sapiens
atgtcaagctttgggtctctggagtataactttttgtaacattagccatt

SEQ ID NO: 1170 - DNA, 50 bp, Homo sapiens
atctaggacacctccatcaaacctcctcttgcactttccctctggcttcc

SEQ ID NO: 1171 - DNA, 50 bp, Homo sapiens
tgtgatgggaacagtgtcttagggagatgcagcttggacttgaggtaaat

SEQ ID NO: 1172 - DNA, 50 bp, Homo sapiens
agaatgggaggccaaccttctatcagagttaaacttttgacaagggaaca

SEQ ID NO: 1173 - DNA, 50 bp, Homo sapiens
aaaaatgtgaaactgccctgcctcccctttttgctgacaacactgtgtac

SEQ ID NO: 1174 - DNA, 50 bp, Homo sapiens
ggccccattacaaaactccttaggaacctcgccctctctctgctgtaagg

SEQ ID NO: 1175 - DNA, 50 bp, Homo sapiens
gctgctgtctagatttatgtgtgctctgacaagaaatgttttgtgtaaca

SEQ ID NO: 1176 - DNA, 50 bp, Homo sapiens
ccaggctgcggtgagaatgccaagaaggcactacctcccacccacatcac

SEQ ID NO: 1177 - DNA, 50 bp, Homo sapiens
ccagttgtcttgaacagcctgactcctgccagccctatggaagttccttt

SEQ ID NO: 1178 - DNA, 50 bp, Homo sapiens; identical to SEQ ID NO: 1177

SEQ ID NO: 1179 - DNA, 50 bp, Homo sapiens
tctttaagaagaccaccacatagaataccccttcctatcagctcgctctg

SEQ ID NO: 1180 - DNA, 50 bp, Homo sapiens
tttgactttcaggatgtcatactacttctgtacctagcattttcagtcct

SEQ ID NO: 1181 - DNA, 50 bp, Homo sapiens
tgcttagatttgttcctgttgtcaaaactgttacccccaaaattggtgtg

SEQ ID NO: 1182 - DNA, 50 bp, Homo sapiens
aacaaggtacatgcattatgtgtcacattactgggcaaactgttcaagta

SEQ ID NO: 1183 - DNA, 50 bp, Homo sapiens
agcacaagcagtgtctgtcactttccatgcataaagtttagtgagatgtt

SEQ ID NO: 1184 - DNA, 50 bp, Homo sapiens
agtgactaaatactgggaacctattttctcaatcttcctccatgttgtgt

SEQ ID NO: 1185 - DNA, 50 bp, Homo sapiens
cttcaggactgtatgagccgagcagttacaagacacaaagaagttaaaaa

SEQ ID NO: 1186 - DNA, 50 bp, Homo sapiens
agggccagatttcatgttgaccctggggatgctgtgaatttctcctgcag

SEQ ID NO: 1187 - DNA, 50 bp, Homo sapiens
aaatgcaggtttattatccagcactgagagagttaacaaggactggaaaa

SEQ ID NO: 1188 - DNA, 50 bp, Homo sapiens; identical to SEQ ID NO: 1187

SEQ ID NO: 1189 - DNA, 50 bp, Homo sapiens
ccctccttaatcaacttcaaggagcaccttcattagtacagcttgcatat

SEQ ID NO: 1190 - DNA, 50 bp, Homo sapiens
aaaccagtgactcctaatctttttcaagttaagacaccttaccattgctt

SEQ ID NO: 1191 - DNA, 50 bp, Homo sapiens
aagggaacacaaaactgtggtcctgacaatactaattctacccgttttca

SEQ ID NO: 1192 - DNA, 50 bp, Homo sapiens
tttttgtacgatcagccttactgctaataaaagcacttccacagggaaaa

SEQ ID NO: 1193 - DNA, 50 bp, Homo sapiens
aaattctacaaaggagaggttgggcgttacaaaggcattgtgaatctaat

SEQ ID NO: 1194 - DNA, 50 bp, Homo sapiens; identical to SEQ ID NO: 1193

SEQ ID NO: 1195 - DNA, 50 bp, Homo sapiens
ttcaccgaggacatgaaactccaccttgcggggataaagagagaaaaaca

SEQ ID NO: 1196 - DNA, 50 bp, Homo sapiens
tgtgctcttcagtagaggattttctgtgatcctacaatgaagggaaagct

SEQ ID NO: 1197 - DNA, 50 bp, Homo sapiens
tttgtgtaaaaccaccttttgaagcagcaactatcaagtctgaaaagcaa

SEQ ID NO: 1198 - DNA, 50 bp, Homo sapiens
agtgggtgaatcacagtaatttccctgtaaaatgtggtacctgaagtcat

SEQ ID NO: 1199 - DNA, 50 bp, Homo sapiens
taggctcatagccttgtatttcgttttagattgtaagctcaatggcaggg

SEQ ID NO: 1200 - DNA, 50 bp, Homo sapiens
gctcaagcaaatgtttggtaatgcagacatgaatacatttcccaccttca

SEQ ID NO: 1201 - DNA, 50 bp, Homo sapiens
aagtcatcatttgccttgaaagtttcctctgcattgggtttgaagtagtt

SEQ ID NO: 1202 - DNA, 50 bp, Homo sapiens
gagcaggggtgggagtggctgtaacttcacaatcctaatacagtaaatgt

SEQ ID NO: 1203 - DNA, 50 bp, Homo sapiens
ttcttaaggagtcttaactcggtacttgggttaacgccagaaattacttt

SEQ ID NO: 1204 - DNA, 50 bp, Homo sapiens
ttggtgagttgccaaagaagcaatacagcatatctgcttttgccttctgt

SEQ ID NO: 1205 - DNA, 50 bp, Homo sapiens
aggccttgtttttcagcttcatctgcagttctatgtgaagattgataaat

SEQ ID NO: 1206 - DNA, 50 bp, Homo sapiens
tgcaacttagaaaccagctacagtatggcccacttaataaaacacctgaa

SEQ ID NO: 1207 - DNA, 50 bp, Homo sapiens
agtttattgttagccaggttgcttgaaaggttgagagtggagtggtttgg

SEQ ID NO: 1208 - DNA, 50 bp, Homo sapiens
gcataactgctctagcttcttgtttaccatagtactgtggcttcagattt

SEQ ID NO: 1209 - DNA, 50 bp, Homo sapiens
tgtatcttttcctgttaaacacacagacccctccccaatctggacattga

SEQ ID NO: 1210 - DNA, 50 bp, Homo sapiens
gccttgccagcctgtgtgcttgtgggaacaccttgtacctgagcttacag

SEQ ID NO: 1211 - DNA, 50 bp, Homo sapiens
gcatgaatgggcaatattttcatctgtttacttgtagtgccatagaggcc

SEQ ID NO: 1212 - DNA, 50 bp, Homo sapiens
ggccttctatgtgcttagccataacaattccattaagcaagaaggtaagc

SEQ ID NO: 1213 - DNA, 50 bp, Homo sapiens
aattgaacaataaccattggtgactggagcaggtaattatagcctgcaga

SEQ ID NO: 1214 - DNA, 50 bp, Homo sapiens
aggggtcccaagagcctgtcctcttttgttcaaaatacatcttgaaacgt

SEQ ID NO: 1215 - DNA, 50 bp, Homo sapiens
cctgctgggactccctgacttactttggttggttcctagtgctacttgtt

SEQ ID NO: 1216 - DNA, 50 bp, Homo sapiens
ggaaagctcgtcagtttagtaggctccgaaatagaatagcagttgtcact

SEQ ID NO: 1217 - DNA, 50 bp, Homo sapiens
agaaggtaactttatagaagtaacaccaatatcctagtctgcttgccccg

SEQ ID NO: 1218 - DNA, 50 bp, Homo sapiens
gctgctccctggttccactctggagagtaatctgggacatcttagtgttt

SEQ ID NO: 1219 - DNA, 50 bp, Homo sapiens
ctctcctcttcccacctctgtatcccacacaggcatctggtgatgttctc

SEQ ID NO: 1220 - DNA, 50 bp, Homo sapiens
acacctgttctttgtaattgggttgtggtgcattttgcactacctggagt

SEQ ID NO: 1221 - DNA, 50 bp, Homo sapiens
agcctaggtgaaaatctatttataaatggaccacaactctggggtgtcgt

SEQ ID NO: 1222 - DNA, 50 bp, Homo sapiens
catgaagctctcaagtcctgcatcctgaggatccagatggatgacaagga

SEQ ID NO: 1223 - DNA, 50 bp, Homo sapiens
ggtggtgtttcctagaccttccctgatgcgattttacctttgttgaattt

SEQ ID NO: 1224 - DNA, 50 bp, Homo sapiens
acgatgctgtttgctctggaatgttcatcttttagacaggttttggctca

SEQ ID NO: 1225 - DNA, 50 bp, Homo sapiens
tccgagggatgagattaaggcagaggcaaaagtttcacacaaagtttctg

SEQ ID NO: 1226 - DNA, 50 bp, Homo sapiens
gccacaactcccatagatgccaatgttttgatagcctcagtttctcaacg

SEQ ID NO: 1227 - DNA, 50 bp, Homo sapiens
tgacccacccaccaaggaagaaagcagaataaacatttttgcactgcctg

SEQ ID NO: 1228 - DNA, 50 bp, Homo sapiens
catgctctcccatgacatctccatgctggtttctccatagcataaatgaa

SEQ ID NO: 1229 - DNA, 50 bp, Homo sapiens
ggtgccgtgcatcaccaaatgaaagtttgtatttaacgaggaggtgcttt

SEQ ID NO: 1230 - DNA, 50 bp, Homo sapiens
aaatcctctctgctgttcacattatcctttgtttaacgtatgaaccaggt

SEQ ID NO: 1231 - DNA, 50 bp, Homo sapiens
gtgtagaattcccggagcgtccgtggttcagagtaaacttgaagcagatc

SEQ ID NO: 1232 - DNA, 50 bp, Homo sapiens
tgggtaggttaagctgccatacgtgttcagtgtgaatagtgtttaagttg

SEQ ID NO: 1233 - DNA, 50 bp, Homo sapiens
tgatgcaagagtggacgtaatgctagttggcagtattttattgtaagaaa

SEQ ID NO: 1234 - DNA, 50 bp, Homo sapiens; identical to SEQ ID NO: 1151

SEQ ID NO: 1235 - DNA, 50 bp, Homo sapiens; identical to SEQ ID NO: 1035

SEQ ID NO: 1236 - DNA, 50 bp, Homo sapiens
aaaatgctgctggcttttctgaagacaggtgcttgaacttgtcagtttgt

SEQ ID NO: 1237 - DNA, 50 bp, Homo sapiens
ccgcccaaaagtctgttctgatggcactgagttttcattgttctggatgt

SEQ ID NO: 1238 - DNA, 50 bp, Homo sapiens
tggttgtgctaaattcatagcaggtgccttattctttgcttttagtcaaa

SEQ ID NO: 1239 - DNA, 50 bp, Homo sapiens
tttgccagggtaatcttcagttggccctgattcaattaaatggccttaat

SEQ ID NO: 1240 - DNA, 50 bp, Homo sapiens
acactccttaagttccaaatgttttccgctaatagtctgtcctaaagcct

SEQ ID NO: 1241 - DNA, 50 bp, Homo sapiens
aggactcttgaacatctgagcagttttgtgctttgagccactttttgaca

SEQ ID NO: 1242 - DNA, 50 bp, Homo sapiens
cgcctatatgaacctggacatatggactaccacagcgaataggaatgcaa

SEQ ID NO: 1243 - DNA, 50 bp, Homo sapiens; identical to SEQ ID NO: 1242

SEQ ID NO: 1244 - DNA, 50 bp, Homo sapiens
tttcctattttgctccagactatgttttcagcataccttgggtctgaaca

SEQ ID NO: 1245 - DNA, 50 bp, Homo sapiens
ttgtgctttctgtatttaaaactttggctgtactaagcaaatgcaaggtt

SEQ ID NO: 1246 - DNA, 50 bp, Homo sapiens
ggtcatcatagttgaggtatgtgtctgctatttgcaaagaagttggtcgt

SEQ ID NO: 1247 - DNA, 50 bp, Homo sapiens
ttcaggaccctagaggagagctttatacaattaccgatgtgaatttctct

SEQ ID NO: 1248 - DNA, 50 bp, Homo sapiens
tgttttgcttaatgtggacaatttacacacccaacacatactgtttccaa

SEQ ID NO: 1249 - DNA, 50 bp, Homo sapiens
gagatcaacgggatgaggtgttacagctgcctccctcttcatgcaatctg

SEQ ID NO: 1250 - DNA, 50 bp, Homo sapiens
aggtagggtttaatccccagtaaaattgccatattgcacatgtcttaatg

SEQ ID NO: 1251 - DNA, 50 bp, Homo sapiens
agggggtgatttttgctcttgtcctgagaaataacagtgctgttttaaaa

SEQ ID NO: 1252 - DNA, 50 bp, Homo sapiens
acttgagtggggttttccttttcccccaattctaagagaatataatgtgt

SEQ ID NO: 1253 - DNA, 50 bp, Homo sapiens
gcgtctgttgttagcaaagaatagattcacacagtctaaggtttccttcc

SEQ ID NO: 1254 - DNA, 50 bp, Homo sapiens
ccctcttagcctatccatcttaagccccaagctgagtgtggttctggtaa

SEQ ID NO: 1255 - DNA, 50 bp, Homo sapiens
taaggagaattagactcccaagtagacaccagagtcactgtttggttggt

SEQ ID NO: 1256 - DNA, 50 bp, Homo sapiens
acgtgtttttgggatatgtttccaatctttaaatgaccttgccctgtcca

SEQ ID NO: 1257 - DNA, 50 bp, Homo sapiens
aaccatttgttaactgtactgaaggtgtgtcctcaagaagaaagtgttca

SEQ ID NO: 1258 - DNA, 50 bp, Homo sapiens
aaacaaactgtgtaactgcccaaagcagcacttataaatcagcctaacat

SEQ ID NO: 1259 - DNA, 50 bp, Homo sapiens
aaactgatcacactgactggatctgtccacgacatggaaaataaactgga

SEQ ID NO: 1260 - DNA, 50 bp, Homo sapiens
ttgcattgatgaattttgtatctgcttccattaaaagcataacagccaca

SEQ ID NO: 1261 - DNA, 50 bp, Homo sapiens
atctctccttcagtctgctctgtttaattctgctgtctgctcttctctaa

SEQ ID NO: 1262 - DNA, 50 bp, Homo sapiens
ttgaagttttaagggacgtcagtgtttatgccatttttccagttccaaaa

SEQ ID NO: 1263 - DNA, 50 bp, Homo sapiens
ggtcggctcttatagagtggccatagtgttctgtcaaaacacttgcttcc

SEQ ID NO: 1264 - DNA, 50 bp, Homo sapiens
ttctccttcacagctaagatgccatgtgcaggtggattccatgccgcaga

SEQ ID NO: 1265 - DNA, 50 bp, Homo sapiens
catgattccaaggatcagcctggatgcctagaggactagatcaccttagt

SEQ ID NO: 1266 - DNA, 50 bp, Homo sapiens
agtgaagatctggctgaaccagttccacaaggttactgtatacatagcct

SEQ ID NO: 1267 - DNA, 50 bp, Homo sapiens
aggccatcattctatacctcatttaagccattgttatcaagggtttaccc

SEQ ID NO: 1268 - DNA, 50 bp, Homo sapiens
agagtacatggaaagttaggtgttcaaattcacatctaatttccctggga

SEQ ID NO: 1269 - DNA, 50 bp, Homo sapiens
gttttcagttttcccctttacagtcttctcccctcacctccaggaccctc

SEQ ID NO: 1270 - DNA, 50 bp, Homo sapiens
atccttcagaatgtgttggtttaccagtgacaccccatattcatcacaaa

SEQ ID NO: 1271 - DNA, 50 bp, Homo sapiens
gtctggccttggcttgctcggataaaactttgtatgtattttgtatggca

SEQ ID NO: 1272 - DNA, 50 bp, Homo sapiens
tgctgagcatggggaatgtggctgctgcagagacgttatgaaacacttct

SEQ ID NO: 1273 - DNA, 50 bp, Homo sapiens
tctccatccttgtgaatgtcctcgtctgtttcaaatacagtgcagtcagt

SEQ ID NO: 1274 - DNA, 51 bp, Homo sapiens
tggttcttctgatgagcaagggaacaacactgagaatgaggaggaaggagt

SEQ ID NO: 1275 - DNA, 50 bp, Homo sapiens
tgaagttaaggattacttggctgccatagcataacaatgaagtgactgaa

SEQ ID NO: 1276 - DNA, 50 bp, Homo sapiens
ggctttcttgttttggtgtcttggagtgctgggtaaggttcagtggatat

SEQ ID NO: 1277 - DNA, 50 bp, Homo sapiens
ctatctacaccatcatgcgctggttccggagacacaaggtgcgggctcac

SEQ ID NO: 1278 - DNA, 50 bp, Homo sapiens
gaagcggctggcaactgaaggctggaacacttgctactggataatcgtag

SEQ ID NO: 1279 - DNA, 50 bp, Homo sapiens
aagcaagagattgtaaaccgggtacagaatccaagagatgagagaggacc

SEQ ID NO: 1280 - DNA, 50 bp, Homo sapiens
agacgaatgcttgtcagttgtagctttccaggattctgctccaatgagga

SEQ ID NO: 1281 - DNA, 50 bp, Homo sapiens
caaactgattgcggggcagggacttgagtatggggagaggctgcaaaaga

SEQ ID NO: 1282 - DNA, 50 bp, Homo sapiens
gaacatcaggagaggagtccagagcccacgtctactgcggaaaagtcagg

SEQ ID NO: 1283 - DNA, 50 bp, Homo sapiens
agttggagagttactcgaacctcaggtgacagttgtaaggcagacatagt

SEQ ID NO: 1284 - DNA, 50 bp, Homo sapiens
ctcctccaggcctctcggatgcctctgttgggacagctaagttcctcttc

SEQ ID NO: 1285 - DNA, 50 bp, Homo sapiens
tcctccatatatccaaacaacaaagcataatatttcgcccactaagccaa

SEQ ID NO: 1286 - DNA, 50 bp, Homo sapiens
tgctgttgcaaaagaagaagacatctctgcctgagttttaattttgtcca

SEQ ID NO: 1287 - DNA, 50 bp, Homo sapiens
tttctgctggagtcccctgtgtcctcagccatcccaagaagggtttgctg

SEQ ID NO: 1288 - DNA, 50 bp, Homo sapiens
ctggttggatctgcatctcacgcccactgcacaccgttcctctccatctg

SEQ ID NO: 1289 - DNA, 50 bp, Homo sapiens
acctcgactccctggtgctctttgcagagttgggcagtgaaattaccttt

SEQ ID NO: 1290 - DNA, 50 bp, Homo sapiens
atacacagcacgacgtatccttgtaccgacttctcccggttcttgtttga

SEQ ID NO: 1291 - DNA, 50 bp, Homo sapiens
gtacttaggaagacacagctagatggacaacagcattgggaggcttagcc

SEQ ID NO: 1292 - DNA, 50 bp, Homo sapiens
catctctggttgtgtctgtgccgactcggtgttgaatcaaatcaggtgtg

SEQ ID NO: 1293 - DNA, 50 bp, Homo sapiens
caacaataggaggtggaatgctgcaaggggctgcaaatgagggcaatgca

SEQ ID NO: 1294 - DNA, 50 bp, Homo sapiens
atatttcactttacatccaaacatcactttggcttcgaagccgccgcctg

SEQ ID NO: 1295 - DNA, 50 bp, Homo sapiens
tggcaaattctgcgagtgtgataatttcaactgtgatagatccaatggct

SEQ ID NO: 1296 - DNA, 50 bp, Homo sapiens
tctcacatgtccatttgaaccacccaaaccaaaaacaaagcataagctgg

SEQ ID NO: 1297 - DNA, 50 bp, Homo sapiens
tccaggatgtctacaaaattggtggtattggtactgttcctgttggccga

SEQ ID NO: 1298 - DNA, 50 bp, Homo sapiens
tggacatagcagcacatactacttcagagttcatgatgtagatgtctggt

SEQ ID NO: 1299 - DNA, 50 bp, Homo sapiens
aacagaagacgaggacacagagcgagaataagcacaactcagacaacaca

SEQ ID NO: 1300 - DNA, 50 bp, Homo sapiens
tgaccacttatgcactttctgaatttgctttccatgctcagagttctgct

SEQ ID NO: 1301 - DNA, 50 bp, Homo sapiens
ctttgaccccaccttgtggaaacccagctgtctactggcagacattggtg

SEQ ID NO: 1302 - DNA, 50 bp, Homo sapiens
aaacaccagtttgcaggaagaaaggaagagaatggaaattgcttctggaa

SEQ ID NO: 1303 - DNA, 50 bp, Homo sapiens
ccctaccatgagccctacaaacaactaacctgccactaatagttatgtca

SEQ ID NO: 1304 - DNA, 50 bp, Homo sapiens
agtcgtattagagccttggcgtaatcatggtcatagctgtttcctgtgtg

SEQ ID NO: 1305 - DNA, 50 bp, Homo sapiens
ttgctgcctgatctgacatacatgatccatcgggttttgttacaaggaac

SEQ ID NO: 1306 - DNA, 50 bp, Homo sapiens
catgttcataggtaatctttgtactctgtgtgcagcagtatttggtttgc

SEQ ID NO: 1307 - DNA, 50 bp, Homo sapiens
aattcgccctatagtgagtcgattaccaatcactgcccgcgtttacaacg

SEQ ID NO: 1308 - DNA, 50 bp, Homo sapiens
acaggtaactgaagatcaaagtaaagcaacagaggaatgtacatctacct

SEQ ID NO: 1309 - DNA, 50 bp, Homo sapiens
aacagttgggcaccctgaatggcaaatggcaaatttggagcgctaataat

SEQ ID NO: 1310 - DNA, 50 bp, Homo sapiens
gccaatcactttattgactcctagccgcagacctcctcattctaacctga

SEQ ID NO: 1311 - DNA, 50 bp, Homo sapiens
atgtgggaggggcatggcagctatgaaggacctcctacctctggtttctg

SEQ ID NO: 1312 - DNA, 50 bp, Homo sapiens
catgggacggggagaaaaagcaaaccctggcacttgggaatacttatacc

SEQ ID NO: 1313 - DNA, 50 bp, Homo sapiens
ttgtgcccttgactgggtatttcttgaagcccttggatctacctttggtc

SEQ ID NO: 1314 - DNA, 50 bp, Homo sapiens
acataatacggttgtgcgagcagagaatctacctttccacttctaagcct

SEQ ID NO: 1315 - DNA, 50 bp, Homo sapiens
ccagcctttgcctcttccttcaatgtggtttccatgggaatttgcttcag

SEQ ID NO: 1316 - DNA, 50 bp, Homo sapiens
aaaacctcgagtcatggtgaatgagtgtctcggagttgctcgtgtgtgta

SEQ ID NO: 1317 - DNA, 50 bp, Homo sapiens
gtgagcacggacatgcggcatcatcgagtgagactggtgttccaagattc

SEQ ID NO: 1318 - DNA, 50 bp, Homo sapiens
caccacagtctcagtgcagggctgggaagtgaaagacgattcaccagacc

SEQ ID NO: 1319 - DNA, 50 bp, Homo sapiens
tttgtgggtgggtgattagtcgttgctgatgagatattttgagggtgggg

SEQ ID NO: 1320 - DNA, 50 bp, Homo sapiens
accttgtaagtgcctaagaaatgagactacaagctccatttcagcaggac

SEQ ID NO: 1321 - DNA, 50 bp, Homo sapiens
gccgagatctgctcagactacatggcttccactatagggttctacagtgt

SEQ ID NO: 1322 - DNA, 50 bp, Homo sapiens
aaatcagaattcatttagctcaccacatctcttgaatgtgattgacctac

SEQ ID NO: 1323 - DNA, 50 bp, Homo sapiens
aggtgtttaacagtgttattttgccactggtaatgtgtaaactgtgagtg

SEQ ID NO: 1324 - DNA, 50 bp, Homo sapiens
tggagtttccaggagaaaaataatcacctttgaaggtttttagagcatgt

SEQ ID NO: 1325 - DNA, 50 bp, Homo sapiens
ggtaacaacatccgtctgaaagggtcggacctcgtccaaaggagataggc

SEQ ID NO: 1326 - DNA, 50 bp, Homo sapiens
acattttgatttcttctctctgtggggtggcaagttgagggagcattctt

SEQ ID NO: 1327 - DNA, 50 bp, Homo sapiens
cgtaaaccaatgtggtacactagttggcccgaacttggtataaaccgcct

SEQ ID NO: 1328 - DNA, 50 bp, Homo sapiens
tctttaagtctgtcaaaccagaactctttgaagcactttgaacaatgccc

SEQ ID NO: 1329 - DNA, 50 bp, Homo sapiens
agctggcgtaatagcgaagaggcccgcaccgatcgcctttccaacaagtg

SEQ ID NO: 1330 - DNA, 50 bp, Homo sapiens
agatgcattttaaatgtctataaatggtgtcataactagagcacgggcgt

SEQ ID NO: 1331 - DNA, 50 bp, Homo sapiens
attaaaacgcttggaagaaaatccccttttggcaggtgggggaaaaagca

SEQ ID NO: 1332 - DNA, 50 bp, Homo sapiens
attcaaccaatagcccttgccgtaccgcctacccgtaacattactggagg

SEQ ID NO: 1333 - DNA, 50 bp, Homo sapiens
cgcctatagcactcgaataattcttctcaccctaacaggtcaacctcgct

SEQ ID NO: 1334 - DNA, 50 bp, Homo sapiens
gttgtgcatgattccccacgtgtctctgtttatccagataagaaaagata

SEQ ID NO: 1335 - DNA, 50 bp, Homo sapiens
tcttttaggatttgtcttttagaatctccagtcctcacaggaaaaccccc

SEQ ID NO: 1336 - DNA, 50 bp, Homo sapiens; identical to SEQ ID NO: 1167

SEQ ID NO: 1337 - DNA, 50 bp, Homo sapiens
acctcattctgacacctgcatatagtgtgggaaattgctctgcatttgac

SEQ ID NO: 1338 - DNA, 50 bp, Homo sapiens
gttctggaggacaggaagggtgacccacagaggattataccaccggggtg

SEQ ID NO: 1339 - DNA, 50 bp, Homo sapiens
gccgcagacctcctcattctaacctgaatcgaaggacaaccagtaagcta

SEQ ID NO: 1340 - DNA, 50 bp, Homo sapiens
tgagtcgtattacaattcactggccgtcgttttacaacgtcgtgactggg

SEQ ID NO: 1341 - DNA, 50 bp, Homo sapiens
taagattatcaaccttggggtcgttttgttgttcgcggattgagcacgga

SEQ ID NO: 1342 - DNA, 50 bp, Homo sapiens
ctgggctgaagcctattcctatggggctctggaatgtttgtgactgaatg

SEQ ID NO: 1343 - DNA, 50 bp, Homo sapiens
ttgtccatttggaacagagtcactataaagaacgggctcaactgggcacc

SEQ ID NO: 1344 - DNA, 50 bp, Homo sapiens
gcagacataggcgaagaaaacatggcattgagtgtgctgagtccagacaa

SEQ ID NO: 1345 - DNA, 50 bp, Homo sapiens
cttttcccaccccctccccctccatgtgaagatttgggtgcttaacatat

SEQ ID NO: 1346 - DNA, 50 bp, Homo sapiens
ggcactgcctccttacctgtgaggaatgcaaaataaagcatggattaagt

SEQ ID NO: 1347 - DNA, 50 bp, Homo sapiens
aaaccacaccaggaactccttgcatggcaaaagctgaacagtacaaatcc

SEQ ID NO: 1348 - DNA, 50 bp, Homo sapiens
acacagtcatccccatgcagaaacctcagaaaacaccaatgtattacaca

SEQ ID NO: 1349 - DNA, 50 bp, Homo sapiens
gtctgaacgagactcaattcctctccgaggctccccaaacaaattgtagc

SEQ ID NO: 1350 - DNA, 50 bp, Homo sapiens
gtgcagtccatcagatccaagcctgtctcttgaggaacaaccgcgcagac

SEQ ID NO: 1351 - DNA, 50 bp, Homo sapiens
gacccaggctatggatgaggctgactattactgtcaggcgtgggacagca

SEQ ID NO: 1352 - DNA, 50 bp, Homo sapiens
tggtggcaaatctgatttttggaaacgagtattggaggactataaaacaa

SEQ ID NO: 1353 - DNA, 50 bp, Homo sapiens
acatttcttgttggcactacagcaaccacatacagtacagacaacctcca

SEQ ID NO: 1354 - DNA, 50 bp, Homo sapiens
tgggataaaggtgtgtcggtttagcacctctggaagacctatctagagct

SEQ ID NO: 1355 - DNA, 50 bp, Homo sapiens
cctggcacatgttgtctggagtctggcacactggttatcaatagcacatt

SEQ ID NO: 1356 - DNA, 50 bp, Homo sapiens
gcatgttctcaccgtgaaggagagtgatgcagggagatactactgtgcag

SEQ ID NO: 1357 - DNA, 50 bp, Homo sapiens
aaagtgggtggaagacttcctggtgcaggaggctcactccgatttaaggt

SEQ ID NO: 1358 - DNA, 50 bp, Homo sapiens
ctgtggtctgttatatgagagagatcctttaactagagcaaagagggagt

SEQ ID NO: 1359 - DNA, 50 bp, Homo sapiens
gcttgctgttccttagaattttgccttgtaagttctagctcaagttgggg

SEQ ID NO: 1360 - DNA, 50 bp, Homo sapiens
tttctcagagctggaggttgctgggcacctaaatgatgtttcatgatagc

SEQ ID NO: 1361 - DNA, 50 bp, Homo sapiens
ctttttgtaagttacaacattccactggatccttatattgcctgtagtgg

SEQ ID NO: 1362 - DNA, 50 bp, Homo sapiens
ctcatctatgtcttctaaagcttttctgcattcttccacctgggattcaa

SEQ ID NO: 1363 - DNA, 50 bp, Homo sapiens
ctgtctttggaaggagacacaagaacctgataacattggttgtcttcggg

SEQ ID NO: 1364 - DNA, 50 bp, Homo sapiens
aaacaagaacccacttaaacacagcatcaaactctaccatgaaatgaaga

SEQ ID NO: 1365 - DNA, 50 bp, Homo sapiens
ttcttcctggtcatattcctcttttgattttctaagaacttccctcagga

SEQ ID NO: 1366 - DNA, 50 bp, Homo sapiens
acacaagatactgccactttctctacacaaagacccacccaaacaccagc

SEQ ID NO: 1367 - DNA, 50 bp, Homo sapiens
ctttctcaggaagtggctctgccaggcaggactatgtgggaaagggtttt

SEQ ID NO: 1368 - DNA, 50 bp, Homo sapiens
attacatgctaactcaaacttacaaaatcaagctctctgtgatcctggtt

SEQ ID NO: 1369 - DNA, 50 bp, Homo sapiens
gattaaaggcttccatcgattgggtagtgtccttcaagtgggtggcgaag

SEQ ID NO: 1370 - DNA, 50 bp, Homo sapiens
tgtattaacaggcttattgctatgcagggaaatagaaggggcattacaaa

SEQ ID NO: 1371 - DNA, 50 bp, Homo sapiens
tggtggatggatggaaacacatacctcctaattaacctgttggtggaaac

SEQ ID NO: 1372 - DNA, 50 bp, Homo sapiens
gccttggagtgtgacatttctgcgagaatgcttaaataccgatttcccgc

SEQ ID NO: 1373 - DNA, 50 bp, Homo sapiens
agggagtcgttttaccaattcactggcccgtgttttacaaacgtctgact

SEQ ID NO: 1374 - DNA, 50 bp, Homo sapiens
tggagagcttgggacaaggtcagaatgaaaacataccagtcaatcctgct

SEQ ID NO: 1375 - DNA, 50 bp, Homo sapiens
acctgtgctctttggatacctaatgcgacatttaagttgtatttgacagt

SEQ ID NO: 1376 - DNA, 50 bp, Homo sapiens
aggctgggcacaaaggagaaaggaggacatggaaaatccgacaattcgaa

SEQ ID NO: 1377 - DNA, 51 bp, Homo sapiens
atctcaaatccttgagcactcagtctagtgaagatgttgtcattatgtaca

SEQ ID NO: 1378 - DNA, 50 bp, Homo sapiens
gggtcataggttcatgggtttgttgagaattgtggctcctggtttctggt

SEQ ID NO: 1379 - DNA, 50 bp, Homo sapiens
gccttctttctgctgactgggggctttcatttaaaaggagtctttttaat

SEQ ID NO: 1380 - DNA, 50 bp, Homo sapiens
tgtaaacagtggcaggagcgtggacttaaaacaaggcttgcttatttggt

SEQ ID NO: 1381 - DNA, 50 bp, Homo sapiens
gccctttgggttaagcctttacattcatgaagacccctccagggtagaat

SEQ ID NO: 1382 - DNA, 50 bp, Homo sapiens
aaaaggaaaacgaaaaaggaaaaggtggccaatgtggaaaaagtttcaat

SEQ ID NO: 1383 - DNA, 50 bp, Homo sapiens
actctcaggagccatgaaagctgcacagttactttatataccacgaggca

SEQ ID NO: 1384 - DNA, 50 bp, Homo sapiens
ttatgtcaccagaatgtttgccaacaccccgaaaaggaaccagaggactt

SEQ ID NO: 1385 - DNA, 50 bp, Homo sapiens
aggttatttgagcacagtgaaagcagagtactatggttgtccaacacagg

SEQ ID NO: 1386 - DNA, 50 bp, Homo sapiens
ggcctgccatccgagggactgtgttgtagattgtgatcaaggttgattgg

SEQ ID NO: 1387 - DNA, 50 bp, Homo sapiens
acaggtagttgaataattgtttcaagagctcaacagatgacaagcttctt

SEQ ID NO: 1388 - DNA, 50 bp, Homo sapiens
aatacactttgtgccaagggaagaacactgcatgccctgggtcttcagtc

SEQ ID NO: 1389 - DNA, 50 bp, Homo sapiens
gggaactggaggtgagaagcattataatagcctctctgcctttatctaca

SEQ ID NO: 1390 - DNA, 50 bp, Homo sapiens
acaagccaaagtggcatgttttgtgcatttgtaaatgctgtgttgggtag

SEQ ID NO: 1391 - DNA, 50 bp, Homo sapiens
aacagactgtcgtagaaaactgtctttgcttccaaatcagcagaggacca

SEQ ID NO: 1392 - DNA, 50 bp, Homo sapiens
gcccctcagaagagccaaactttgagttttatgtctgtttgtcattgata

SEQ ID NO: 1393 - DNA, 50 bp, Homo sapiens
ccttgtgtccaacgggaataggaagaattagttactgacttcacctgaga

SEQ ID NO: 1394 - DNA, 50 bp, Homo sapiens
cccacaattggactgatagggggagaaaatccaaagagacggagcaactg

SEQ ID NO: 1395 - DNA, 50 bp, Homo sapiens
aacggcaactgggagatttgtgagtgaacactgtttcatcttaatatgct

SEQ ID NO: 1396 - DNA, 50 bp, Homo sapiens
acatctgagaaaccctgaatcctgcaatcaagtagaagtcaacttcatct

SEQ ID NO: 1397 - DNA, 50 bp, Homo sapiens
gccataggaaggtttaccagtagaatccttgctaggttgatgtgggccat

SEQ ID NO: 1398 - DNA, 50 bp, Homo sapiens
tcatctcaacttagtattatacccacacccacccaagaacagggtttgtt

SEQ ID NO: 1399 - DNA, 50 bp, Homo sapiens
gactgaaagatttagccataatgtaaactgcctcaaattggactttgggc

SEQ ID NO: 1400 - DNA, 50 bp, Homo sapiens
ggcactgtctgtgtccttccttgaactgtctaccctgttgcttttcacaa

SEQ ID NO: 1401 - DNA, 50 bp, Homo sapiens
ggccagccgaggctacaaaaactaaccctggatcctactctcttattaaa

SEQ ID NO: 1402 - DNA, 50 bp, Homo sapiens
actaggttgcaatatgtgaaatcagaggaccaaagtacagatggaaacca

SEQ ID NO: 1403 - DNA, 50 bp, Homo sapiens
ccctgtctgactacaacatccagaaagagtccactctgcacttggtcctg

SEQ ID NO: 1404 - DNA, 50 bp, Homo sapiens
ggcatcgcccatgctcctcacctgtattttgtaatcagaaataaattgct

SEQ ID NO: 1405 - DNA, 50 bp, Homo sapiens
aaagcaacgaaaggaacgcaagaacagaatgaagaaagtcagggggactg

SEQ ID NO: 1406 - DNA, 50 bp, Homo sapiens
tcccactttgtctgtacatactggcctctgtgattacatagatcagccat

SEQ ID NO: 1407 - DNA, 50 bp, Homo sapiens; identical to SEQ ID NO: 1278

SEQ ID NO: 1408 - DNA, 50 bp, Homo sapiens
cagtcacgtcagttatgtagatactgcatggcaggagagctttacgctaa

SEQ ID NO: 1409 - DNA, 50 bp, Homo sapiens
gccacccctcacacagccaaaccccagatcatctgaaactactaactttg

SEQ ID NO: 1410 - DNA, 50 bp, Homo sapiens
gcaggtgaccattggcacacgctagaagtttatggcagagctttacaaat

SEQ ID NO: 1411 - DNA, 50 bp, Homo sapiens
tgccatgctgctaggaaattgtcctttttctttctagctgttaacctact

SEQ ID NO: 1412 - DNA, 50 bp, Homo sapiens
aacttattccagtgttgatcgcaagctgttgatgcacaggcgtcttgtgg

SEQ ID NO: 1413 - DNA, 50 bp, Homo sapiens
tgaaaaggattaaagctggtattctagaacatgcccttcactggttgtgt

SEQ ID NO: 1414 - DNA, 50 bp, Homo sapiens
ggtaaggtttctaggaggtctgttaggtgtacatcctgcagcttattggc

SEQ ID NO: 1415 - DNA, 50 bp, Homo sapiens
tgattctgtaaagctgtggaatgaagctgcagatttagagaacattggct

SEQ ID NO: 1416 - DNA, 50 bp, Homo sapiens
cgattttacacggctgggtagaatttgtagaaaagatccacagggcaagc

SEQ ID NO: 1417 - DNA, 50 bp, Homo sapiens
gctactacttcattgcaacctttattactgaccacatcagacatcatgct

SEQ ID NO: 1418 - DNA, 50 bp, Homo sapiens
gggctgaagtacctaagtgtgaatgtctctcccgttaaactgagtgtaga

SEQ ID NO: 1419 - DNA, 50 bp, Homo sapiens
aggaaaacggttcaccagtgtttagttttatattgaggtgctcaggttgg

SEQ ID NO: 1420 - DNA, 50 bp, Homo sapiens
ccgggccttgcatataaataacggagcatacagtgagcacatctagctga

SEQ ID NO: 1421 - DNA, 50 bp, Homo sapiens
ataatgaaagctaagcctcgggctaatttccccatagccgtggggtgact

SEQ ID NO: 1422 - DNA, 50 bp, Homo sapiens; identical to SEQ ID NO: 75

SEQ ID NO: 1423 - DNA, 50 bp, Homo sapiens
tgctctgttctggtttctgttttcaaatcaaatgcctgtttgggaggaga

SEQ ID NO: 1424 - DNA, 50 bp, Homo sapiens
caaaatcccaaaaccagggccaaggagtggacgcttctcttgtgagccag

SEQ ID NO: 1425 - DNA, 50 bp, Homo sapiens
acaaatttcttggctggatttgaagcttaaactcctgtggattcacatca

SEQ ID NO: 1426 - DNA, 50 bp, Homo sapiens
tccacggttgtgccttattgttccattaaaattgtatcttcgatccatca

SEQ ID NO: 1427 - DNA, 50 bp, Homo sapiens
ggtctgagagtctgtgaagatggcccagtcttctatcccccacctaaaaa

SEQ ID NO: 1428 - DNA, 50 bp, Homo sapiens
acacacaggagggaaaatcctgggattctttttctagggatgtaatacat

SEQ ID NO: 1429 - DNA, 50 bp, Homo sapiens
ctgtttgaactgttgagtttccgttgctggctgagtgcgttttgtccttc

SEQ ID NO: 1430 - DNA, 50 bp, Homo sapiens; identical to SEQ ID NO: 1427

SEQ ID NO: 1431 - DNA, 50 bp, Homo sapiens
ggtacagagaagccagcttgtttacatgcttattccatgactgcttgccc

SEQ ID NO: 1432 - DNA, 50 bp, Homo sapiens; identical to SEQ ID NO: 1431

SEQ ID NO: 1433 - DNA, 50 bp, Homo sapiens
gggagaatgaatgtgcaacgtggctgaaatctattttgtgtaataaaagg

SEQ ID NO: 1434 - DNA, 50 bp, Homo sapiens
ccccaccaccccattaccacagctgcctttgtgtgtttgtgtcaataaaa

SEQ ID NO: 1435 - DNA, 50 bp, Homo sapiens
ccagcaagataatgtcctgtcttctaagatgtgcatcaagcctggtacat

SEQ ID NO: 1436 - DNA, 50 bp, Homo sapiens; identical to SEQ ID NO: 1052

SEQ ID NO: 1437 - DNA, 50 bp, Homo sapiens
gctactagagagcaaggggctttcttaccaccagtgctgaggagaaaagt

SEQ ID NO: 1438 - DNA, 50 bp, Homo sapiens
accaagaaaccagcccctgaaaagaagcctgcagagaagaaacctactac

SEQ ID NO: 1439 - DNA, 50 bp, Homo sapiens
tttcctcatctatgaattgtcattcacacacctacttttctgcttcgttt

SEQ ID NO: 1440 - DNA, 50 bp, Homo sapiens; identical to SEQ ID NO: 1439

SEQ ID NO: 1441 - DNA, 50 bp, Homo sapiens
aataatgacaaatgccctgcacctacccacatgcactcgtgtgagacaag

SEQ ID NO: 1442 - DNA, 50 bp, Homo sapiens
gtgcccctgtgggtcccagggaggtcttaaacaaggtatttttcaactta

SEQ ID NO: 1443 - DNA, 50 bp, Homo sapiens
cagtgaagacgtcaggggcaaggtctcgggggtccggaagggtgatcatc

SEQ ID NO: 1444 - DNA, 50 bp, Homo sapiens
tgcaagggagacatatcctagatcactttgctttttctttaaggagctga

SEQ ID NO: 1445 - DNA, 50 bp, Homo sapiens; identical to SEQ ID NO: 75

SEQ ID NO: 1446 - DNA, 50 bp, Homo sapiens
ttgggggaggttagggacttatcctgtgcttgtaaataaataaggtcatg

SEQ ID NO: 1447 - DNA, 50 bp, Homo sapiens
acttggctgccatagcataacaatgaagtgactgaaaaatccagaatttc

SEQ ID NO: 1448 - DNA, 50 bp, Homo sapiens
aaaatattaaacacaaactaccacctacctccctcaccaaagcccataaa

SEQ ID NO: 1449 - DNA, 50 bp, Homo sapiens
agctgtttggtaaccatagtttcacttgttcaaagctgtgtaatcgtggg

SEQ ID NO: 1450 - DNA, 50 bp, Homo sapiens; identical to SEQ ID NO: 1449

SEQ ID NO: 1451 - DNA, 50 bp, Homo sapiens
tgtcgccttttagaaggagaaacttaagtgtggaatgcattatatgggca

SEQ ID NO: 1452 - DNA, 50 bp, Homo sapiens; identical to SEQ ID NO: 1124

SEQ ID NO: 1453 - DNA, 50 bp, Homo sapiens
tttggagtggaggcattgtttttaagaaaaacatgtcatgtaggttgtct

SEQ ID NO: 1454 - DNA, 50 bp, Homo sapiens
tggctgggacgctagaagggtcatgtgttaactataatcacatttatggt

SEQ ID NO: 1455 - DNA, 50 bp, Homo sapiens
attctggttaaccgctcacatgcataacaataatgctagaaattcaggaa

SEQ ID NO: 1456 - DNA, 50 bp, Homo sapiens
tgctgatttctagtgtatactctgtagtctcagttcgtgtttgattccat

SEQ ID NO: 1457 - DNA, 50 bp, Homo sapiens
aaatgaatctttcaaaggtttcccaaaccactccttatgatccagtgata

SEQ ID NO: 1458 - DNA, 50 bp, Homo sapiens; identical to SEQ ID NO: 1124

SEQ ID NO: 1459 - DNA, 50 bp, Homo sapiens
tgcgtgtgcctcagtttcctcctccacaactgaatatttatagtggctga

SEQ ID NO: 1460 - DNA, 50 bp, Homo sapiens
gggatgtggaggatttttgttaagtgtcaatcgaagttaaaaagcaaggg

SEQ ID NO: 1461 - DNA, 50 bp, Homo sapiens
agctctctgcacccttacccctttccaccttttgtatttaattttaaagt

SEQ ID NO: 1462 - DNA, 50 bp, Homo sapiens
ccctccagccaataggcagctttcttaactatcctaacaagccttggacc

SEQ ID NO: 1463 - DNA, 50 bp, Homo sapiens
cgtggttgtgggaggggaaagaggaaacagagctagtcagatgtgaattg

SEQ ID NO: 1464 - DNA, 50 bp, Homo sapiens
acaatgtgttagcagaaaccagtgggttataatgtagaatgatgtgcttt

SEQ ID NO: 1465 - DNA, 50 bp, Homo sapiens
gctagatccccggtggttttgtgctcaaaataaaaagcctcagtgaccca

SEQ ID NO: 1466 - DNA, 50 bp, Homo sapiens; identical to SEQ ID NO: 1425

SEQ ID NO: 1467 - DNA, 50 bp, Homo sapiens
gctgtggttggttgcattacatgacacagaaaactgtcctctacctcacg

SEQ ID NO: 1468 - DNA, 50 bp, Homo sapiens
gccctggtaggctcctttagaaggaccatttctgttcctagagcttaact

SEQ ID NO: 1469 - DNA, 50 bp, Homo sapiens; identical to SEQ ID NO: 1404

SEQ ID NO: 1470 - DNA, 50 bp, Homo sapiens
tttccctctcctgtccttgtgttgaaggcagtaaactaagggtgtcaagc

SEQ ID NO: 1471 - DNA, 50 bp, Homo sapiens
agactggaaatggggatgagggtgtaaattgtattgaaaaagatcgcgaa

SEQ ID NO: 1472 - DNA, 50 bp, Homo sapiens
ccatgagttgtttggttttccagaagctgccagtgggttcccgtgaattg

SEQ ID NO: 1473 - DNA, 50 bp, Homo sapiens
gatacgatgagatccgccgtcactggggtggcaatgtcctgggtcctaag

SEQ ID NO: 1474 - DNA, 50 bp, Homo sapiens
agtctttctggtttctggagataacccatcaataaagctgcttcctctgg

SEQ ID NO: 1475 - DNA, 50 bp, Homo sapiens
cgatgatggttacccttcatggacgtcttaatcttccacacacatcccct

SEQ ID NO: 1476 - DNA, 50 bp, Homo sapiens
ggcccctggacatgtacctgcagaataataaagtcatcaatacctaaaaa

SEQ ID NO: 1477 - DNA, 50 bp, Homo sapiens
gcaaacctgcagattcccaagatgttcacgagcttgtgctttctaaagaa

SEQ ID NO: 1478 - DNA, 50 bp, Homo sapiens
tccccattgtgccgcctttatcaattgcctgttttgttttgtttgttttt

SEQ ID NO: 1479 - DNA, 50 bp, Homo sapiens
ctttagctgctgttgcctcccttctcaggctggtgctggatccttcctag

SEQ ID NO: 1480 - DNA, 50 bp, Homo sapiens
ctgcttatggcacaatttgcctcaaaatccattccaagttgtatatttgt

SEQ ID NO: 1481 - DNA, 50 bp, Homo sapiens
ctgcttctgggtgcatggtagactttgtggcatttgatacaacttggaca

SEQ ID NO: 1482 - DNA, 50 bp, Homo sapiens
cttatagtatttatccacccaaaccccagactgagatactgctcccaggg

SEQ ID NO: 1483 - DNA, 50 bp, Homo sapiens
gagagaccagcctttcttcctttggtaggaatggcctgagttggcgttgt

SEQ ID NO: 1484 - DNA, 50 bp, Homo sapiens
cagaggtgggagtaactgctggtagtgccttctttggttgtgttgctcag

SEQ ID NO: 1485 - DNA, 50 bp, Homo sapiens
ctgtgtgccccagctgcatcagccagcttctaggtggctccattgttttc

SEQ ID NO: 1486 - DNA, 50 bp, Homo sapiens
agagcagaatagcaatataagagcacagacgaacatagacacgacagcga

SEQ ID NO: 1487 - DNA, 50 bp, Homo sapiens
ctattaggacccagtgattatgctaccttggcacggttagggtactgcgg

SEQ ID NO: 1488 - DNA, 50 bp, Homo sapiens
aaagaagcatgcacacttatcacaaacaactctctcaggtggccagtctg

SEQ ID NO: 1489 - DNA, 50 bp, Homo sapiens
tgctgcctatatgaagtctttgagaaagcccctcttggagtctgtgcctt

SEQ ID NO: 1490 - DNA, 50 bp, Homo sapiens
gatatacgaggacaaaacccatctaccaggcagctaacaaaccgccgcca

SEQ ID NO: 1491 - DNA, 50 bp, Homo sapiens
gccactttattagtaatggtcgatagtccgaatcgatggctagggtgact

SEQ ID NO: 1492 - DNA, 50 bp, Homo sapiens
taatctggcgggttatacccccgtgttctccggattatatttcgggacac

SEQ ID NO: 1493 - DNA, 50 bp, Homo sapiens
gctggatttgtgggtatgggggcggtttttgggcgaaggttggttgttac

SEQ ID NO: 1494 - DNA, 50 bp, Homo sapiens
ccacatcatcgggggcgaaatagaagcccagagagaggctaggtgtagga

SEQ ID NO: 1495 - DNA, 50 bp, Homo sapiens
agggagactctcagccttcagcttcctaaattctgtgtctgtgactttcg

SEQ ID NO: 1496 - DNA, 50 bp, Homo sapiens
ttgtcaagctgctgctgtcttcaagatctacctggtcagaatctcctgct

SEQ ID NO: 1497 - DNA, 50 bp, Homo sapiens
ggccagtctctatgtgtcttaatcccttgtccttcattaaaagcaaaact

SEQ ID NO: 1498 - DNA, 50 bp, Homo sapiens
tctctcacattctgtctttcccctcctccttcaccttccctccgtccctc

SEQ ID NO: 1499 - DNA, 50 bp, Homo sapiens
acacgagactatagagaatgcagcacacagatgagagcagagcaaataga

SEQ ID NO: 1500 - DNA, 50 bp, Homo sapiens
gcatccagatggtggtttactctgcaacagtctaatgttcttcacttcca

SEQ ID NO: 1501 - DNA, 50 bp, Homo sapiens
ggggttttcaccctacctaaagatgctttaattgctgttttccaaattgt

SEQ ID NO: 1502 - DNA, 50 bp, Homo sapiens
atgcctaacaagcaacatgatcctataaatccaccccaagccaatctggt

SEQ ID NO: 1503 - DNA, 50 bp, Homo sapiens
ccaccatctggtacgtttttacttcctcacccgcgtgtactccgattacc

SEQ ID NO: 1504 - DNA, 50 bp, Homo sapiens
gagtatattcccccagttatttgctcttccccacacagggtggtagtacc

SEQ ID NO: 1505 - DNA, 50 bp, Homo sapiens
caaaggaaggggcgtgaaggggtgagaaaaatatgggacccaaattgtgg

SEQ ID NO: 1506 - DNA, 50 bp, Homo sapiens
tttccttacaggcggtaacaccggtccacacagttcttgccaaaacaaag

SEQ ID NO: 1507 - DNA, 50 bp, Homo sapiens
aattttctctcacctcatcactcgggacctccccagtgataataacccgg

SEQ ID NO: 1508 - DNA, 50 bp, Homo sapiens
gcgggtgtaaggggatatcttgataaactggagcccaggaagattacaaa

SEQ ID NO: 1509 - DNA, 50 bp, Homo sapiens
acgccgacaatcaagaaaatgtgagttataacggacaaggttgtattatg

SEQ ID NO: 1510 - DNA, 50 bp, Homo sapiens
gatattggtagtaaaggggttacctgtgaacttccaaaattccttggggc

SEQ ID NO: 1511 - DNA, 50 bp, Homo sapiens
taaagatgtccgggtacacttcgccaagggttagcgtctttgggcatttc

SEQ ID NO: 1512 - DNA, 50 bp, Homo sapiens
tcctaatttcttctgtgaaccttctcaaatcccccagcatgcgtgtagtg

SEQ ID NO: 1513 - DNA, 50 bp, Homo sapiens
ctgcatgatgtcatcaacctgctgtagtgcggaaacgaccacaacacaca

SEQ ID NO: 1514 - DNA, 50 bp, Homo sapiens
aaagacgaacgagacacgaaagcaacgaacgaacacagagcacgccgcac

SEQ ID NO: 1515 - DNA, 50 bp, Homo sapiens
tttcaacacgcatcccttatgggcgaactgtcctcaaacaacaacaagtg

SEQ ID NO: 1516 - DNA, 50 bp, Homo sapiens
taggacgagaaacgaagaaggacagagcgagaacaagtaagcagggacac

SEQ ID NO: 1517 - DNA, 50 bp, Homo sapiens
ggtggagaatcaaaacgaccccgcaaataaacatggcgatttggcttggg

SEQ ID NO: 1518 - DNA, 50 bp, Homo sapiens
tggccttttaaataactgggcttctcacaaccatagtgaacagaaacagc

SEQ ID NO: 1519 - DNA, 50 bp, Homo sapiens
attgtgacatggtgatgcctcattgctgatatggtcctgtggttatgtgc

SEQ ID NO: 1520 - DNA, 50 bp, Homo sapiens
ggaagagataacaccacaacgaaagagcaggcaagagagaccaaagcaca

SEQ ID NO: 1521 - DNA, 50 bp, Homo sapiens
ggtaaaaggcgttactctccgccctcttcaaggaacggccaagagtataa

SEQ ID NO: 1522 - DNA, 50 bp, Homo sapiens
acccaagggtctcgccagtggggttaagtcacaatattactacacaaggg

SEQ ID NO: 1523 - DNA, 50 bp, Homo sapiens
acagtacacaatcacctgcaagggacatagcacacaaaccgctaaagagg

SEQ ID NO: 1524 - DNA, 50 bp, Homo sapiens
tctcacagcgagaggaggagacgggatgaccgagaggtagacgattatac

SEQ ID NO: 1525 - DNA, 50 bp, Homo sapiens
cgctggtgttgtccccaagtgatttattctactggagtgcctggtgtctt

SEQ ID NO: 1526 - DNA, 50 bp, Homo sapiens
ttccggcttttaacaaacacacaccacactaacacaacaacacaaacaaa

SEQ ID NO: 1527 - DNA, 50 bp, Homo sapiens
aagacttgcctctttaaaattgctttgttttctgcagtactatctgtggt

SEQ ID NO: 1528 - DNA, 50 bp, Homo sapiens
gaactcgtccactcttctcgggccactattctggttcagggaatcttggg

SEQ ID NO: 1529 - DNA, 50 bp, Homo sapiens
agcaataaaccgaagcagctagacagcgaagaagtacagcaaagagacga

SEQ ID NO: 1530 - DNA, 50 bp, Homo sapiens
cgcccatactagagaagtttgccctctattgtctctcacaccacaatgag

SEQ ID NO: 1531 - DNA, 50 bp, Homo sapiens
cacagacatccacggacacaaaaggcggggaccaccaccacaatgaacac

SEQ ID NO: 1532 - DNA, 50 bp, Homo sapiens
gcgtcgattgatatcagacagcatcgtctctgcgagcacaaagatctgtt

SEQ ID NO: 1533 - DNA, 50 bp, Homo sapiens
ggaacagggttaatggccaggccctttgccgccccttttaaagggaatcc

SEQ ID NO: 1534 - DNA, 50 bp, Homo sapiens
acagagtaacatgggatatgggtatgagtgggatgtgctgagaaggaact

SEQ ID NO: 1535 - DNA, 50 bp, Homo sapiens
gggggcaaagaaagtacattgggtgaaaatttaaaaaggtatggagcatt

SEQ ID NO: 1536 - DNA, 50 bp, Homo sapiens
caaacgaacagcgaagacaacaactcacgatgctgcacaacgcgaccaac

SEQ ID NO: 1537 - DNA, 50 bp, Homo sapiens
acattttataaggcatttgtgttagccactcagtcatctttgggtgctgc

SEQ ID NO: 1538 - DNA, 50 bp, Homo sapiens
gtcacagcaacgtgtcgctccccagatcatttattagcgtcgattgttgt

SEQ ID NO: 1539 - DNA, 50 bp, Homo sapiens
attccaaacgggatctgctgagacctcacagaggtgggccgcgattataa

SEQ ID NO: 1540 - DNA, 50 bp, Homo sapiens
cctagggtgaaacacgtgacagaagaataaagactattgaatagtcctct

SEQ ID NO: 1541 - DNA, 50 bp, Homo sapiens; identical to SEQ ID NO: 1315

SEQ ID NO: 1542 - DNA, 50 bp, Homo sapiens
ccccttgtttactctgtctgtatgtatgtcaaaagcgtggcaaaacctct

SEQ ID NO: 1543 - DNA, 50 bp, Homo sapiens
catgatctcagaggaaactgtcgctgaccctggacatgggtacgtttgac

SEQ ID NO: 1544 - DNA, 50 bp, Homo sapiens
cctctacctgcacgacaatacataatgacccaccaatcacatgcctatca

SEQ ID NO: 1545 - DNA, 50 bp, Homo sapiens
atttggaagcgccaccctagcaaatatacaaaccattaaaccttccctct

SEQ ID NO: 1546 - DNA, 50 bp, Homo sapiens
tttaccaatgattttcaggtgacctgggctaagtcatttaaactgggtct

SEQ ID NO: 1547 - DNA, 50 bp, Homo sapiens
agtttacatatcgacagcatatccactgatttctaaatgggctggtccca

SEQ ID NO: 1548 - DNA, 50 bp, Homo sapiens
atctggagtgggacccttcaaaccatgtctgtgcttatgcgggaaacaat

SEQ ID NO: 1549 - DNA, 50 bp, Homo sapiens
gcggagagaagaagaggtagatatgagaacagtgtgtggtatatgatagt

SEQ ID NO: 1550 - DNA, 50 bp, Homo sapiens
gaaatcccaccggcaagttaaggtcacggagcaagtgaataaacgcggag

SEQ ID NO: 1551 - DNA, 50 bp, Homo sapiens
gtgatcaaacaaattcacagcacagacaccgcgcaacaacgcaacttctc

SEQ ID NO: 1552 - DNA, 50 bp, Homo sapiens
ggtatttgtgttgttgagtattgtgtctgggtgtgggtatttgattcttt

SEQ ID NO: 1553 - DNA, 50 bp, Homo sapiens
gggttcgtccagggctgcgctaaattattctcaatgatttgtctctttgc

SEQ ID NO: 1554 - DNA, 50 bp, Homo sapiens
caatgacgcagtcggaccctcggatccaagtcctgctttgggtgtggacc

SEQ ID NO: 1555 - DNA, 50 bp, Homo sapiens
gggttataatagatggacgggtctttcacggtggtgacagcaccctttcc

SEQ ID NO: 1556 - DNA, 50 bp, Homo sapiens
tccgctgcaatttgagtttagctttacagattgtgccgggtgtttaacct

SEQ ID NO: 1557 - DNA, 50 bp, Homo sapiens
ctccttcccaaagacttgagtggaacttccctttcatgtgcgtatcggtc

SEQ ID NO: 1558 - DNA, 50 bp, Homo sapiens
aaattagtcgccttcgtcgagagtgcccttctgatgaatgtggtgctggg

SEQ ID NO: 1559 - DNA, 50 bp, Homo sapiens
gacagtactcctaagacccctgtgtgtgtcccgatgagatcatgactggg

SEQ ID NO: 1560 - DNA, 50 bp, Homo sapiens
catgcccatcgtcctagaattaattcccctaaaaatctttgaaatagggc

SEQ ID NO: 1561 - DNA, 50 bp, Homo sapiens
ggcgtatcatcaactggtgagcccgaagggatattatttctaaggcctct

SEQ ID NO: 1562 - DNA, 50 bp, Homo sapiens
ccagaatcgtaagggggctgacggaggatgagagggggcacccagagatc

SEQ ID NO: 1563 - DNA, 50 bp, Homo sapiens
cggtgttttctgatcggtttttgttttctgcttacatatgatgtacttgt

SEQ ID NO: 1564 - DNA, 50 bp, Homo sapiens
acagaatgcagcggtgcaacaccggcaaggttccacacgccacaaagaaa

SEQ ID NO: 1565 - DNA, 50 bp, Homo sapiens
tggaagtgaagtctatgatgtgaaacactttgcctcctgtgtactgtgtc

SEQ ID NO: 1566 - DNA, 50 bp, Homo sapiens
ccaaaaagcttcatttttctatataggctgcacaagagccttgattgaag

SEQ ID NO: 1567 - DNA, 50 bp, Homo sapiens
tcacaagacagtcatcagaaccagtaaatatccgtctgccagttcgatca

SEQ ID NO: 1568 - DNA, 50 bp, Homo sapiens; identical to SEQ ID NO: 1567

SEQ ID NO: 1569 - DNA, 50 bp, Homo sapiens
gctgtcatttgtacatttaaagcagctgttttggggtctgtgagagtaca

SEQ ID NO: 1570 - DNA, 50 bp, Homo sapiens
tatcctgagtcccttaatcttatggggccggaaggaatgtcagggccagg

SEQ ID NO: 1571 - DNA, 50 bp, Homo sapiens
ctctgccttcggagggaaattgtaaatcctgtgtttcattacttgaatgt

SEQ ID NO: 1572 - DNA, 50 bp, Homo sapiens
aaactcctgcttaaggtgttctaattttctgtgagcacactaaaagcgaa

SEQ ID NO: 1573 - DNA, 50 bp, Homo sapiens
gggtgcacgttcctcctggttccttcgcttgtgtttctgtacttaccaaa

SEQ ID NO: 1574 - DNA, 50 bp, Homo sapiens
ggggttgggaggaagtgtctactaggagggtgggtgagatctgtgttgat

SEQ ID NO: 1575 - DNA, 50 bp, Homo sapiens
atctaccctccgattgttcctgaaccgatgagaaataaagtttctgttga

SEQ ID NO: 1576 - DNA, 50 bp, Homo sapiens
aagtcttatgccaaattcagtgctactcctcgttacatgacatacaactg

SEQ ID NO: 1577 - DNA, 50 bp, Homo sapiens
cacacggaggcatctgcaccctcgatgaagcccaataaacctcttttctc

SEQ ID NO: 1578 - DNA, 50 bp, Homo sapiens
acaacgtcgtgactgggaaaaccctggcgttacccaacttaatcgccttg

SEQ ID NO: 1579 - DNA, 50 bp, Homo sapiens
ccaagcctccaagtgggaagaaagactgggatgatgaccaaaatgattga

SEQ ID NO: 1580 - DNA, 50 bp, Homo sapiens
caactacttgtggcatgcattggcactcggaataaagcgcactattgtca

SEQ ID NO: 1581 - DNA, 50 bp, Homo sapiens
gaaggggtagggtccaccatactggtaattggggtactctgtatatgtgt

SEQ ID NO: 1582 - DNA, 50 bp, Homo sapiens
gctcagttccatatttcatccgtgaaaaacttgcaatacgagcagtttca

SEQ ID NO: 1583 - DNA, 50 bp, Homo sapiens
aattgtcatttacctgggtatgaattccctgacacacattcatgtcaaca

SEQ ID NO: 1584 - DNA, 50 bp, Homo sapiens
gtgacttgactgtggaagatgatggttgcatgtttctagtttgtatatgt

SEQ ID NO: 1585 - DNA, 50 bp, Homo sapiens
cagtgctgtaatacagacggcaatgcaatagcctatttaaagaactacgt

SEQ ID NO: 1586 - DNA, 50 bp, Homo sapiens
agctggtggatggtgacttttgaagaacaaaaggctttggcaacagaaaa

SEQ ID NO: 1587 - DNA, 50 bp, Homo sapiens
tctgttgtcactaaagactaaatgagggtttgcagttgggaaagaggtca

SEQ ID NO: 1588 - DNA, 50 bp, Homo sapiens
gcggagttgaccaaaataatatctgaggatgattgcttttccctgctgcc

SEQ ID NO: 1589 - DNA, 50 bp, Homo sapiens
catcttgaacttggcctgagaacattttctgggaagaggtaagggtgaca

SEQ ID NO: 1590 - DNA, 50 bp, Homo sapiens
tctgtggaatctccttcattggcattgttatttaatcataaacggggcag

SEQ ID NO: 1591 - DNA, 50 bp, Homo sapiens
tgtactgttcatgctgacacagatatttcagtctgcatggtaaaagttct

SEQ ID NO: 1592 - DNA, 50 bp, Homo sapiens
taatggggtttatatggactttcttctcataaatggcctgccgtctccct

SEQ ID NO: 1593 - DNA, 50 bp, Homo sapiens; identical to SEQ ID NO: 1438

SEQ ID NO: 1594 - DNA, 50 bp, Homo sapiens
agtcctgtgtgcttccctctcttatgactgtgtccctggttgtcaataaa

SEQ ID NO: 1595 - DNA, 50 bp, Homo sapiens
acccaccacctcttgcactctcgcttttggagcaagttgcattaactatt

SEQ ID NO: 1596 - DNA, 50 bp, Homo sapiens
tgacagttgcagaattgtggagtgtttttacattgatcttttgctaatgc

SEQ ID NO: 1597 - DNA, 50 bp, Homo sapiens
atgacagacacacgtatctaacaaacaaacaaacagtgaccttctccatg

SEQ ID NO: 1598 - DNA, 50 bp, Homo sapiens
gcaagggataatacaaatcctatgatctctatgcccaatatgctgcctca

SEQ ID NO: 1599 - DNA, 50 bp, Homo sapiens
agtacttttcacagcgtggcctttcaccataattttatatttctccccct

SEQ ID NO: 1600 - DNA, 50 bp, Homo sapiens
tcttaagagccagagccatataagcatcttgggaaagcaagtttgaacca

SEQ ID NO: 1601 - DNA, 50 bp, Homo sapiens
aagccggtcatgagattatatgtggtaaagttaattgactaacaacccca

SEQ ID NO: 1602 - DNA, 50 bp, Homo sapiens
agggggctgtgtctgatcttggtgttcaaaacagaactgtatttttgcct

SEQ ID NO: 1603 - DNA, 50 bp, Homo sapiens
gttcatagcttcctgcaacttgacagagcctgagtttgcctcttagtggg

SEQ ID NO: 1604 - DNA, 50 bp, Homo sapiens
catatgggagaagggggagtaatgacttgtacaaacagtatttctggtgt

SEQ ID NO: 1605 - DNA, 50 bp, Homo sapiens
acatgtgatgtttgactgtaccattgactgttatggaagttcagcgttgt

SEQ ID NO: 1606 - DNA, 50 bp, Homo sapiens
tcttgcttttattcctttttgttgttggccttgtgctgcgtttgtttaca

SEQ ID NO: 1607 - DNA, 50 bp, Homo sapiens
agtgttgttttctcctctttaatattgctgtgaacagtggtgcccattgt

SEQ ID NO: 1608 - DNA, 50 bp, Homo sapiens
aattcttgtgtgctgctttccatttgacaccgcagttctgttcagccatc

SEQ ID NO: 1609 - DNA, 50 bp, Homo sapiens
gaggtgtctccatctctgcctcaacttcatggtgcactgagctgtaactt

SEQ ID NO: 1610 - DNA, 50 bp, Homo sapiens; identical to SEQ ID NO: 276

SEQ ID NO: 1611 - DNA, 50 bp, Homo sapiens
tattttcttccattcttgtcattggtcaataggggagggtagattagctg

SEQ ID NO: 1612 - DNA, 50 bp, Homo sapiens
tcccctgcttccactaaatccagttgtgacaaaatctaacgtgacatcag

SEQ ID NO: 1613 - DNA, 50 bp, Homo sapiens
acctggtcaacttagcttttaagcagacgatgctgtaaaaactaacggct

SEQ ID NO: 1614 - DNA, 50 bp, Homo sapiens
acctgggatgcccctgctctggacctctcatttctcttcattggtttatt

SEQ ID NO: 1615 - DNA, 50 bp, Homo sapiens
atctatccttgccagccttgggcatcacatttaccagtttaatagattgt

SEQ ID NO: 1616 - DNA, 50 bp, Homo sapiens
gccctgatctggagttacctgaggccatagctgccctattcacttctaag

SEQ ID NO: 1617 - DNA, 50 bp, Homo sapiens
cttgaccaaacccacagcctgtctcttctcttgtttagttacttacggca

SEQ ID NO: 1618 - DNA, 50 bp, Homo sapiens
ccttagaagaggaagcaaaggcagattcagggaccaaaaggattaatgat

SEQ ID NO: 1619 - DNA, 50 bp, Homo sapiens
atgtgtcaaccaccatttcagctattaaaaactcctgttatctccttgtt

SEQ ID NO: 1620 - DNA, 50 bp, Homo sapiens
agccaccagagccttcctctctttgtaccacagtttcttctgtaaatcca

SEQ ID NO: 1621 - DNA, 50 bp, Homo sapiens
acatgaaatatagttgcatatatggacaccgacttgggaggacaggtcct

SEQ ID NO: 1622 - DNA, 50 bp, Homo sapiens
ctttccagcctcctgctgggctctctcttcctaccctccttccacatgta

SEQ ID NO: 1623 - DNA, 50 bp, Homo sapiens
agatagccagcctagaggtatggctgtaactatctctgtgaagtgtgaga

SEQ ID NO: 1624 - DNA, 50 bp, Homo sapiens
tggcatcctcaggggttgtgatccagctccatatattgtttaccttcaaa

SEQ ID NO: 1625 - DNA, 50 bp, Homo sapiens
catgaggagagtgctagttcatgtgttctccattcttgtgagcatcctaa

SEQ ID NO: 1626 - DNA, 50 bp, Homo sapiens
cagcaaatccatctgaactgtggaggagaagctctctttactgagggtgc

SEQ ID NO: 1627 - DNA, 50 bp, Homo sapiens
tcagcataaactggaatgtagtgtcagaggatactgtggcttgttttgtt

SEQ ID NO: 1628 - DNA, 50 bp, Homo sapiens
tggtgaaacaaaaccagtcattagaaatggtctgtgcttttattttccca

SEQ ID NO: 1629 - DNA, 50 bp, Homo sapiens
actatgctttattggtcccatgttttgtgcaattttaaagagatggcttt

SEQ ID NO: 1630 - DNA, 50 bp, Homo sapiens
aaagatgaactatttggtctcattgaagccaacacagaacttgctgctgt

SEQ ID NO: 1631 - DNA, 50 bp, Homo sapiens
ggagcccctctttctcccatgctgcacttactccttttgctaataaaagt

SEQ ID NO: 1632 - DNA, 50 bp, Homo sapiens
ccttccatgtcccaccccactcccaccaaaaagtacaaaatcaggatgtt

SEQ ID NO: 1633 - DNA, 50 bp, Homo sapiens
tgatggtaaccataatggaagagattctggctagtgtctatcagaggtga

SEQ ID NO: 1634 - DNA, 50 bp, Homo sapiens
gtcctggtggtatcttcaatagccactaaccctgcctggtacagtatggg

SEQ ID NO: 1635 - DNA, 50 bp, Homo sapiens
cccagctctgctgcccttgttttgctgcatgttaaataaaaccattttca

SEQ ID NO: 1636 - DNA, 50 bp, Homo sapiens
cccacactgctacacttctgatcccctttggttttactacccaaatctaa

SEQ ID NO: 1637 - DNA, 50 bp, Homo sapiens
ctgtaatacctcctcctaaccaagccggatatggtatggcaagttaccaa

SEQ ID NO: 1638 - DNA, 50 bp, Homo sapiens
cccttgtaagggaattctggggcagctatggtttgagtatgcagtttgca

SEQ ID NO: 1639 - DNA, 50 bp, Homo sapiens
acaatctctgtccagcacctcttggttaaataatgtatgctgtgagacat

SEQ ID NO: 1640 - DNA, 50 bp, Homo sapiens
acagggcctcagcaagggagccatacatttttgtaacattttgatatgtt

SEQ ID NO: 1641 - DNA, 50 bp, Homo sapiens
ttgactgtcgatggattgtggtgtggtgtatctgaaggctattgaatgca

SEQ ID NO: 1642 - DNA, 50 bp, Homo sapiens
ttctgttccaaacaagtattctgtagatccaaatggattaccagtgtgct

SEQ ID NO: 1643 - DNA, 50 bp, Homo sapiens
atcttcagaatcagttaggttcctcactgcaagaaataaaatgtcaggca

SEQ ID NO: 1644 - DNA, 50 bp, Homo sapiens
tgaaccttactgcaaaaacttgtgatgtaagaaatttgtatggtgtggca

SEQ ID NO: 1645 - DNA, 50 bp, Homo sapiens
gctgtctcaagggtatccgtacctcaatgtcagttacattcagcagaaaa

SEQ ID NO: 1646 - DNA, 50 bp, Homo sapiens
ttggtcagatttagaagcattcatgctcacaagttttgggaaagtgaaaa

SEQ ID NO: 1647 - DNA, 50 bp, Homo sapiens
ccctaaaggcaagaagaaaaagtaaaagaccttggctcatagaaagtcac

SEQ ID NO: 1648 - DNA, 50 bp, Homo sapiens
gtgtgtgcatggaagatgcctgggctgtctttgctatatgtaaatagagc

SEQ ID NO: 1649 - DNA, 50 bp, Homo sapiens
gccttggctttatttgcaggctactaaagctgcttttactttgtaacttt

SEQ ID NO: 1650 - DNA, 50 bp, Homo sapiens
acagtttggttacaggacttctgtgcattgtaaacataaacagcatggaa

SEQ ID NO: 1651 - DNA, 50 bp, Homo sapiens
tgtgaaagtgtggaatggaagaaatgtcgatcctgttgtaactgattgtg

SEQ ID NO: 1652 - DNA, 50 bp, Homo sapiens
acaaccaaccagtttcttttctagccaatcatctctgaagagttgctgtt

SEQ ID NO: 1653 - DNA, 50 bp, Homo sapiens
gaactccctgattctataccctcttccttctttctgcaaggcagaggaat

SEQ ID NO: 1654 - DNA, 50 bp, Homo sapiens
caccctcagctccaccctcagcagatgataatatcaagacacctgccgag

SEQ ID NO: 1655 - DNA, 50 bp, Homo sapiens
ttggccctcaggtttactgtgtaaatctgcatttttggtggtaaatccct

SEQ ID NO: 1656 - DNA, 50 bp, Homo sapiens
gcatttccatagcactgaagtaccagtttccattcctgggctgagattgt

SEQ ID NO: 1657 - DNA, 50 bp, Homo sapiens
ctccttttaacgtgttattgacaaacctccccaaaagaatatgcaattgt

SEQ ID NO: 1658 - DNA, 50 bp, Homo sapiens
aacattcagttgagaccatatgcattttctgtgctgtttgtacttgaggt

SEQ ID NO: 1659 - DNA, 50 bp, Homo sapiens
ttaaccctcagagaactctgcattttagggtacttgaggctgacttaact

SEQ ID NO: 1660 - DNA, 50 bp, Homo sapiens
agcgacctcttctctagtccggtgttacgaacagaagttctgagttgtgc

SEQ ID NO: 1661 - DNA, 50 bp, Homo sapiens
taaatgtcggtccaggccctgtgcaccttaccccagagacagactctttt

SEQ ID NO: 1662 - DNA, 50 bp, Homo sapiens
ataaggctgtaaaatgagaattctgccccctcacctcttaccccagtact

SEQ ID NO: 1663 - DNA, 50 bp, Homo sapiens
aaaagtcggggatcggggcaagagaggctgagtacggatgggaaactatt

SEQ ID NO: 1664 - DNA, 50 bp, Homo sapiens
gagcacccagagggatttttcagtgggaagcattacactttgctaaatca

SEQ ID NO: 1665 - DNA, 50 bp, Homo sapiens
tgattaggtgacgagttgacattgagattgtccttttcccctgatcaaaa

SEQ ID NO: 1666 - DNA, 50 bp, Homo sapiens
tgtatgtatgggagtgaggagtttcagggccattgcaaacatagctgtgc

SEQ ID NO: 1667 - DNA, 50 bp, Homo sapiens
acagagttatccactttacaacggagacacagttctggaacattgaaact

SEQ ID NO: 1668 - DNA, 50 bp, Homo sapiens
atacgggacaataaaatctgccttttgctctggagggagatactacctct

SEQ ID NO: 1669 - DNA, 50 bp, Homo sapiens
gggcaaacaactttaggaatactagttactcacttaacatggagggcggg

SEQ ID NO: 1670 - DNA, 50 bp, Homo sapiens
aaaggccgcgcagattgtttaattctggaaagtcaatccccggatttagc

SEQ ID NO: 1671 - DNA, 50 bp, Homo sapiens
gggactccatgggaatatttgcccagtaatggtaaggaaatctttcgggt

SEQ ID NO: 1672 - DNA, 50 bp, Homo sapiens
ccagaaaggtgatgaatgaataggactgagagtcacagtgaatgtggcat

SEQ ID NO: 1673 - DNA, 50 bp, Homo sapiens
tcccaaggttgttagtgactgataagcttccaaactacagtacagttttt

SEQ ID NO: 1674 - DNA, 50 bp, Homo sapiens
gttttcttgtagttgcgggtccctcgcgaaagttcattcatggccccact

SEQ ID NO: 1675 - DNA, 50 bp, Homo sapiens
catggggctctcttgtgtacttattgtttaaggtttcctcaaactgtgat

SEQ ID NO: 1676 - DNA, 50 bp, Homo sapiens
acaaattgaaatgtctgtactgatcctcaaccaataaaatctcagccgaa

SEQ ID NO: 1677 - DNA, 50 bp, Homo sapiens
tgcaggagacattggtattctgggcagcttcctaatatgctttacaatct

SEQ ID NO: 1678 - DNA, 50 bp, Homo sapiens; identical to SEQ ID NO: 33

SEQ ID NO: 1679 - DNA, 50 bp, Homo sapiens
ggcattgttagtttagtgtgtgtgcagagtccatttcccacatctttcct

SEQ ID NO: 1680 - DNA, 50 bp, Homo sapiens
gactgcaatgctggtggggaaagacttaaaagtggattaaagacctgcgt

SEQ ID NO: 1681 - DNA, 50 bp, Homo sapiens
gctttccttctccaggaatactgaacatgggagctcttgaaatatgtagt

SEQ ID NO: 1682 - DNA, 50 bp, Homo sapiens
tgggaatcaagatttaatcctagagatttggtgtacaattcaggctttgg

SEQ ID NO: 1683 - DNA, 50 bp, Homo sapiens
gcagtagtgtggactagaacaacccaaatagcatctagaaagccatgagt

SEQ ID NO: 1684 - DNA, 50 bp, Homo sapiens
tgtgtaatgtacctgtcagtgcctcctttattaaggggttctttgagaat

SEQ ID NO: 1685 - DNA, 50 bp, Homo sapiens
ccactgtcactgtttctctgctgttgcaaatacatggataacacatttga

SEQ ID NO: 1686 - DNA, 50 bp, Homo sapiens
agtttgccctggatgtcatattggcagttggaggacacagtttctattgt

SEQ ID NO: 1687 - DNA, 50 bp, Homo sapiens
ccaagttccacattccttctagcgtgccttacatcaggtactttgtcagc

SEQ ID NO: 1688 - DNA, 50 bp, Homo sapiens
agctgtctcctgttttgtaagctttcagtgcaacatttcttggttccaat

SEQ ID NO: 1689 - DNA, 50 bp, Homo sapiens
tgcatgttggggtttcctttaccttttctataagttgtaccaaaacatcc

SEQ ID NO: 1690 - DNA, 50 bp, Homo sapiens
gggtttgtgctatacactgggatgtctaattgcagcaataaagcctttct

SEQ ID NO: 1691 - DNA, 50 bp, Homo sapiens
gccacacttattcttttcagtaacctgctagtgcacaggctgtactttag

SEQ ID NO: 1692 - DNA, 50 bp, Homo sapiens
cagtcgaaggctttaactttgcacacttgggatcacagttgcgtcattgt

SEQ ID NO: 1693 - DNA, 50 bp, Homo sapiens
ttccctttccccagcatcactccccaaggaagagccaatgttttccaccc

SEQ ID NO: 1694 - DNA, 50 bp, Homo sapiens
agccataatgtaaactgcctcaaattggactttgggcataaaagaacttt

SEQ ID NO: 1695 - DNA, 50 bp, Homo sapiens
ttgcttttactagtcttagctctacgatttaaatccatgtgtccaagggg

SEQ ID NO: 1696 - DNA, 50 bp, Homo sapiens
cacacctgcacactcacggctgaaatctccctaacccagggggaccttag

SEQ ID NO: 1697 - DNA, 50 bp, Homo sapiens
agctgtaacgttcgcgttaggaaagatggtgtttattccagtttgcattt

SEQ ID NO: 1698 - DNA, 50 bp, Homo sapiens
aggggttccactagtgtctgctttcctttattattgcactgtgtgaggtt

SEQ ID NO: 1699 - DNA, 50 bp, Homo sapiens
catcctcaggtggtcaggcgtagatcaccagaataaacccagcttccctc

SEQ ID NO: 1700 - DNA, 50 bp, Homo sapiens
acacacaacgtgaaaaataggaacaggaacaaaaagaagaccaatgactc

SEQ ID NO: 1701 - DNA, 50 bp, Homo sapiens
tttagagtcttccattttgttggaattagatcctccccttcaaatgctgt

SEQ ID NO: 1702 - DNA, 50 bp, Homo sapiens
ctaatttcagtgcttgtgcttggttgttcagggccatttcaggtttgggt

SEQ ID NO: 1703 - DNA, 50 bp, Homo sapiens; identical to SEQ ID NO: 206

SEQ ID NO: 1704 - DNA, 50 bp, Homo sapiens; identical to SEQ ID NO: 818

SEQ ID NO: 1705 - DNA, 50 bp, Homo sapiens
aggtggtgttcagtgtcagacctcttaatggccagtgaataacactcact

SEQ ID NO: 1706 - DNA, 50 bp, Homo sapiens
gggggtagtttgtggcaggacaagagaaggcattgagctttttctttcat

SEQ ID NO: 1707 - DNA, 50 bp, Homo sapiens
tcgttaagagagcaacattttacccacacacagataaagttttcccttga

SEQ ID NO: 1708 - DNA, 50 bp, Homo sapiens; identical to SEQ ID NO: 86

SEQ ID NO: 1709 - DNA, 50 bp, Homo sapiens
aaacaaggtaggaatgaggctagacctttaacttccctaaggcatacttt

SEQ ID NO: 1710 - DNA, 50 bp, Homo sapiens
ttccccatatccaagtaccaatgctgttgtaaacaacgtgtatagtgcct

SEQ ID NO: 1711 - DNA, 50 bp, Homo sapiens
tgagcctttcacacctgtgctggcgctggaaaattatttgtgctcagctg

SEQ ID NO: 1712 - DNA, 50 bp, Homo sapiens
tgggattgtactataccagtaagtgccacttctgtgtctttctaatggaa

SEQ ID NO: 1713 - DNA, 50 bp, Homo sapiens
tttttcctcacaggagcggaagaactagggggagcaggagctgcaatgcg

SEQ ID NO: 1714 - DNA, 50 bp, Homo sapiens
tctacccatttcctgaggcctgtggaaataaacctttatgtacttaaagt

SEQ ID NO: 1715 - DNA, 50 bp, Homo sapiens
gtgtccgttatgagtgccaaaaatctgtcttgaaggcagctacactttga

SEQ ID NO: 1716 - DNA, 50 bp, Homo sapiens
ctgtgcaatgctacatgtacgtggacttatatcagaccagtgtggatctt

SEQ ID NO: 1717 - DNA, 50 bp, Homo sapiens
agtcccctgtcctggtcatctatcaagataacaagcggccctcagggatc

SEQ ID NO: 1718 - DNA, 50 bp, Homo sapiens
gggtctatgtgaaaatgcccccaacagagccagaatgtgaaaagcaattt

SEQ ID NO: 1719 - DNA, 50 bp, Homo sapiens
cttgccttaagctaccagattgcttttgccaccattggccatactgtgtg

SEQ ID NO: 1720 - DNA, 50 bp, Homo sapiens
cccctgccagagggagttcttcttttgtgagagacactgtaaacgacaca

SEQ ID NO: 1721 - DNA, 50 bp, Homo sapiens
tgcagccactattgttagtctcttgattcataatgacttaagcacacttg

SEQ ID NO: 1722 - DNA, 50 bp, Homo sapiens
tgactattactgtcaggcgtgggacaccaacactgcggtattcggcggag

SEQ ID NO: 1723 - DNA, 50 bp, Homo sapiens
tttgagacgcaataccaatacttaggattttggtcttggtgtttgtatga

SEQ ID NO: 1724 - DNA, 50 bp, Homo sapiens
tccttccagggcttctttgtgtctgtgttctactgtttcctcaatagtga

SEQ ID NO: 1725 - DNA, 50 bp, Homo sapiens
ccatgtccatccccacctccccaacccgtgtcagctttcacagcatcaag

SEQ ID NO: 1726 - DNA, 50 bp, Homo sapiens
tgccctcaagtaaaagaaaagccgaaagggttaatcatatttgaaaacca

SEQ ID NO: 1727 - DNA, 50 bp, Homo sapiens
atgctacttgggagaaaactctcactaactgtctcaccgggtttcaaagc

SEQ ID NO: 1728 - DNA, 50 bp, Homo sapiens
ggactttgcgaatatcagagacctcagactcttcacagggtcaggactca

SEQ ID NO: 1729 - DNA, 50 bp, Homo sapiens
agctccctgcaagtcacatttcccagtgaaacactgaacttatcagaaaa

SEQ ID NO: 1730 - DNA, 50 bp, Homo sapiens
ttccttcaggatgatctagagcagcatggagctgttggtagaatattagt

SEQ ID NO: 1731 - DNA, 50 bp, Homo sapiens
ggggaggaaggaaggacattaaattctttccctggtaatgaaaagagccc

SEQ ID NO: 1732 - DNA, 50 bp, Homo sapiens
gccttgtacataatactattccatccacacagtttccaccctcacctgcc

SEQ ID NO: 1733 - DNA, 50 bp, Homo sapiens
agcaagatagccaaatgtgacatcaagctccattgtttcggaaatccagg

SEQ ID NO: 1734 - DNA, 50 bp, Homo sapiens
gccgagtgaggtaaccaggtggcatctaccccatgttttataaggaattt

SEQ ID NO: 1735 - DNA, 50 bp, Homo sapiens
ttctttccatttgctatcatgtcagtgaacgccaggagtgctttctttgc

SEQ ID NO: 1736 - DNA, 50 bp, Homo sapiens
tgaatttacttcctcccaagagtttggactgcccgtcagattgtttctgc

SEQ ID NO: 1737 - DNA, 50 bp, Homo sapiens
accctcatttccagggggagcctcaggccccgagataaatgtgctccatg

SEQ ID NO: 1738 - DNA, 50 bp, Homo sapiens
ttctctgagggctgggggttgggggagtcagcatgattatattttaatgt

SEQ ID NO: 1739 - DNA, 50 bp, Homo sapiens
acttggctgtaatcagttatgccgtataggatgtcagacaataccactgg

SEQ ID NO: 1740 - DNA, 50 bp, Homo sapiens
tggagctcagtaacataactgcttcttggagctttggaatattttatcct

SEQ ID NO: 1741 - DNA, 50 bp, Homo sapiens
aaatttcacaagcaatactttggaccactggggttcaggccccaagaaat

SEQ ID NO: 1742 - DNA, 50 bp, Homo sapiens
acacacaaaacagcaaacttcaggtaactattttggattgcaaacaggat

SEQ ID NO: 1743 - DNA, 50 bp, Homo sapiens
tcttgccttaattaacattccctgtgacctagttggtgcagtggcttgaa

SEQ ID NO: 1744 - DNA, 50 bp, Homo sapiens
acttgcagttgtgtggaaaactgttttgtaatgaaagatcttcattgggg

SEQ ID NO: 1745 - DNA, 50 bp, Homo sapiens
tgtgatctctactactgttgattttgccctcggagcaaactgaataaagc

SEQ ID NO: 1746 - DNA, 50 bp, Homo sapiens
taggaaatgtttgacatctgaagctctcttcacactcccgtggcactcct

SEQ ID NO: 1747 - DNA, 50 bp, Homo sapiens
cgtcccctctccccttggttctgcactgttgccaataaaaagctcttaaa

SEQ ID NO: 1748 - DNA, 50 bp, Homo sapiens
gggagtgttgtgactgaaatgcttgaaaccaaagcttcagataaacttgc

SEQ ID NO: 1749 - DNA, 50 bp, Homo sapiens
aggggacagaaatcaggtattggcagtttttccattttcatttgtgtgtg

SEQ ID NO: 1750 - DNA, 50 bp, Homo sapiens
agccgcccagctacctaattcctcagtaacatcgatctaaaatctccatg

SEQ ID NO: 1751 - DNA, 50 bp, Homo sapiens
acatgcaagtacatgtttttaatgttgtctgtcttctgtgctgttcctgt

SEQ ID NO: 1752 - DNA, 50 bp, Homo sapiens
cctgtgtgggactgagatgcaggatttcttcacacctctcctttgtgact

SEQ ID NO: 1753 - DNA, 50 bp, Homo sapiens
ggcatctgaatgtgtctgcgttcctgttagcataatgtgaggaggtggag

SEQ ID NO: 1754 - DNA, 50 bp, Homo sapiens
ctgagagcccaaactgctgtcccaaacatgcacttccttgcttaaggtat

SEQ ID NO: 1755 - DNA, 50 bp, Homo sapiens
aagctccctggagccctgttggcagctctagcttttgcagtcgtgtaatg

SEQ ID NO: 1756 - DNA, 50 bp, Homo sapiens
agccctctttctctccacccaatgctgctttctcctgttcatcctgatgg

SEQ ID NO: 1757 - DNA, 50 bp, Homo sapiens
tccacaggggtggtgtcaaatgctattgaaattgtgttgaattgtatgct

SEQ ID NO: 1758 - DNA, 50 bp, Homo sapiens; identical to SEQ ID NO: 1465

SEQ ID NO: 1759 - DNA, 50 bp, Homo sapiens
gacttccacagcagcagaacaagtgcctcctggactgttcacggcagacc

SEQ ID NO: 1760 - DNA, 50 bp, Homo sapiens
tatccccagctcaggtggtgagtcctcctgtccagcctgcatcaataaaa

SEQ ID NO: 1761 - DNA, 50 bp, Homo sapiens
ctgggttttgtggtcatctattctagcagggaacactaaaggtggaaata

SEQ ID NO: 1762 - DNA, 50 bp, Homo sapiens
agctatggaatcaattcaatttggactggtgtgctctctttaaatcaagt

SEQ ID NO: 1763 - DNA, 50 bp, Homo sapiens
tggctcaagtagaaaagcagtcccattcatattaagacagtgtacaaaac

SEQ ID NO: 1764 - DNA, 50 bp, Homo sapiens
agctcttgaaagcagctttgagttagaagtatgtgtgttacaccctcaca

SEQ ID NO: 1765 - DNA, 50 bp, Homo sapiens
aaccggatatatacatagcatgacatttctttgtgctttggcttacttgt

SEQ ID NO: 1766 - DNA, 50 bp, Homo sapiens; identical to SEQ ID NO: 270

SEQ ID NO: 1767 - DNA, 50 bp, Homo sapiens
aaagttgatactgtgggatttttgtgaacagcctgatgtttgggaccttt

SEQ ID NO: 1768 - DNA, 50 bp, Homo sapiens
cttccttagctcctgttcttggcctgaagcctcacagctttgatggcagt

SEQ ID NO: 1769 - DNA, 50 bp, Homo sapiens
tttgtgcttccctttacctaaactgtcctgcctcccatgcatctgtaccc

SEQ ID NO: 1770 - DNA, 50 bp, Homo sapiens; identical to SEQ ID NO: 1769

SEQ ID NO: 1771 - DNA, 50 bp, Homo sapiens
cttgtggcttcctcagctcctgcccttggcctgaagtcccagcattgatg

SEQ ID NO: 1772 - DNA, 50 bp, Homo sapiens
atttgtttgcatccctcccccacaccctggtgttttaaaatgaagaaaaa

SEQ ID NO: 1773 - DNA, 50 bp, Homo sapiens
catccgacataatcctacaggtgctgtgttattcatggggcagataaaca

SEQ ID NO: 1774 - DNA, 50 bp, Homo sapiens
agtggggtggggagcatgttcatttgtacctcgagttttaaactggttcc

SEQ ID NO: 1775 - DNA, 50 bp, Homo sapiens
cctaaaccgtatggcctcccgtgcatctgtattcaccctgtatgacaaac

SEQ ID NO: 1776 - DNA, 50 bp, Homo sapiens
tttcatctcaggcctccctcaaccccaccacttcttttataactagtcct

SEQ ID NO: 1777 - DNA, 50 bp, Homo sapiens
gcatggcttaacctggtgataaaagcagttattaaaagtctacgttttcc

SEQ ID NO: 1778 - DNA, 50 bp, Homo sapiens
agcttccgccgtctcaacccctcacaggagcttactggcaaacatgaaaa

SEQ ID NO: 1779 - DNA, 50 bp, Homo sapiens
tctcctccacctcaactccgtgcttaaccaaagaagctgtactccggggg

SEQ ID NO: 1780 - DNA, 50 bp, Homo sapiens
acccaagggacctggatttggtgtacaagcaggcctttaatttatattga

SEQ ID NO: 1781 - DNA, 50 bp, Homo sapiens
agctcctcttcctggcttcttactgaaaggttaccctgtaacatgcaatt

SEQ ID NO: 1782 - DNA, 50 bp, Homo sapiens; identical to SEQ ID NO: 194

SEQ ID NO: 1783 - DNA, 50 bp, Homo sapiens
ccaccccaaccttctggtggggagaaataaacggtttagagacagctctg

SEQ ID NO: 1784 - DNA, 50 bp, Homo sapiens
gccaagggccaagagaatatccgaactttaatttcaggaattgaatgggt

SEQ ID NO: 1785 - DNA, 50 bp, Homo sapiens; identical to SEQ ID NO: 150

SEQ ID NO: 1786 - DNA, 50 bp, Homo sapiens
ccggttgttaaaactggtttagcacaatttatattttccctctcttgcct

SEQ ID NO: 1787 - DNA, 50 bp, Homo sapiens
attaaagcaccaaattcatgtacagcatgcatcacggatcaatagactgt

SEQ ID NO: 1788 - DNA, 50 bp, Homo sapiens
tagccgtactttgctaactgtgctcctcacttcctcttcttcattgcagt

SEQ ID NO: 1789 - DNA, 50 bp, Homo sapiens
aggctaagctgccggttcttaaatccatcctgctaagttaatgttgggta

SEQ ID NO: 1790 - DNA, 50 bp, Homo sapiens
aatatatgcatccctggtgaaggatcttgcctgcatgaaacatgttctca

SEQ ID NO: 1791 - DNA, 50 bp, Homo sapiens
acctgggcattcttgtttcattcaattccacctgcaatcaagtcctacaa

SEQ ID NO: 1792 - DNA, 50 bp, Homo sapiens
ctccctcacagcacagagaagacaaaattagcaaaaccccactacacagt

SEQ ID NO: 1793 - DNA, 50 bp, Homo sapiens
gttcagtggcactcaacatgagtcaagagcatcctgcttctaccatgtgg

SEQ ID NO: 1794 - DNA, 50 bp, Homo sapiens
cttgagctagaagtctccaaggaggtcgggatggggcttgtagcagaagg

SEQ ID NO: 1795 - DNA, 50 bp, Homo sapiens
ctcccaactcctccctatcctaaaggcccactggcattaaagtgctgtat

SEQ ID NO: 1796 - DNA, 50 bp, Homo sapiens
tcggtcctctttccagtggatcataagacaatggaccctttttgttatga

SEQ ID NO: 1797 - DNA, 50 bp, Homo sapiens
aacacacagtgtttatgttggaatcttttggaactcctttgatctcactg

SEQ ID NO: 1798 - DNA, 50 bp, Homo sapiens
ggggctctttccctcatgtatacttcaagtaagatcaagaatcttttgtg

SEQ ID NO: 1799 - DNA, 50 bp, Homo sapiens
tcatcctctgtgtggctcatgtttttgcttttcaacacacaaagcacaaa

SEQ ID NO: 1800 - DNA, 50 bp, Homo sapiens
tggatgattgggactttaaaacgaccctctttcaggtggattcagagacc

SEQ ID NO: 1801 - DNA, 50 bp, Homo sapiens
tgtagcttctgaaaggtgctttctccatttatttaaaaactacccatgca

SEQ ID NO: 1802 - DNA, 50 bp, Homo sapiens
tgtagcaacatgagaaacgcttatgttacaggttacatgagagcaatcat

SEQ ID NO: 1803 - DNA, 50 bp, Homo sapiens
ctgatggctgtgaccctgcttcctgcactgacccagagcctctgcctgtg

SEQ ID NO: 1804 - DNA, 50 bp, Homo sapiens
tgtgtgttgatcccaagacaatgaaagtttgcactgtatgctggacggca

SEQ ID NO: 1805 - DNA, 50 bp, Homo sapiens
ctctcctcagactgctcaagagaagcacatgaaaaccattacctgacttt

SEQ ID NO: 1806 - DNA, 50 bp, Homo sapiens
gccagtaagatcaatgtgacggcagggaaatgtatgtgtgtctattttgt

SEQ ID NO: 1807 - DNA, 50 bp, Homo sapiens
gcaacaatgaagttaatggataccctctgcctttggctcagaaatgttat

SEQ ID NO: 1808 - DNA, 50 bp, Homo sapiens
tgtctttcggttatcaagtgtttctgcatggtaatgtcatgtaaatgctg

SEQ ID NO: 1809 - DNA, 50 bp, Homo sapiens
tatcatggggagtaataggaccagagcggtatctctggcaccacactagc

SEQ ID NO: 1810 - DNA, 50 bp, Homo sapiens
tgatcttggctgtatttaatggcataggctgacttttgcagatggaggaa

SEQ ID NO: 1811 - DNA, 50 bp, Homo sapiens
agtactgagaaaaatcccttcagctctaagaacactgaaaaatccaccga

SEQ ID NO: 1812 - DNA, 50 bp, Homo sapiens
actttgcacacatttgcatccacatattagggaaggaataagtagctgca

SEQ ID NO: 1813 - DNA, 50 bp, Homo sapiens
atgcagtgtttccctctgtgttagagcagagaggtttcgatatttattga

SEQ ID NO: 1814 - DNA, 50 bp, Homo sapiens
tgctgaagtttcccttagacattttatgtcttgcttgtagggcataatgc

SEQ ID NO: 1815 - DNA, 50 bp, Homo sapiens
cactggaccattgtcacaaccctctgtttctctttgactaagtgccctgg

SEQ ID NO: 1816 - DNA, 50 bp, Homo sapiens
aagtgttactgtggcttcaaagaagctattgattctgaagtagtgggttt

SEQ ID NO: 1817 - DNA, 50 bp, Homo sapiens
gctgcttatatatttaataataaaagaagtgcacaagctgccgttgacgt

SEQ ID NO: 1818 - DNA, 50 bp, Homo sapiens
aacaaacatttggttttgttcagaccttatttccactctggtggataagt

SEQ ID NO: 1819 - DNA, 50 bp, Homo sapiens
gagagagggcacgagaacccaaaggaatagagattctccaggaatttcct

SEQ ID NO: 1820 - DNA, 50 bp, Homo sapiens
ttcccagcatcagccttagaacaagaaccttaccttcaaggagcaagtga

SEQ ID NO: 1821 - DNA, 50 bp, Homo sapiens
ctgtccagctccctctccccaagaaacaacatgaatgagcaacttcagag

SEQ ID NO: 1822 - DNA, 50 bp, Homo sapiens
ctgtaacgacgagagcggcgaggatgtcgaggttccctatgtccgataca

SEQ ID NO: 1823 - DNA, 50 bp, Homo sapiens
acctagtcatcaggacactgagccagggctgcaaccactccatgagtttg

SEQ ID NO: 1824 - DNA, 50 bp, Homo sapiens
ccccaaccctctgggctcttggatttcagagtgaaaacttgatggcattg

SEQ ID NO: 1825 - DNA, 50 bp, Homo sapiens
tcaattcctctgggaatgttacattgtttgtctgtcttcatagcagattt

SEQ ID NO: 1826 - DNA, 50 bp, Homo sapiens
accagtttctttcccttctagatcaccctgttctgaagccagcctctctc

SEQ ID NO: 1827 - DNA, 50 bp, Homo sapiens
ctacctgaacccctcttgccactgccttctaccttgtttgaaacctgaat

SEQ ID NO: 1828 - DNA, 50 bp, Homo sapiens
aactcgagaccttttcaacttggcttcctttcttggttcataaatgaatt

SEQ ID NO: 1829 - DNA, 50 bp, Homo sapiens
agctgctgctggatcacagctgctttctgttgtcattgctgttgtccctc

SEQ ID NO: 1830 - DNA, 50 bp, Homo sapiens; identical to SEQ ID NO: 110

SEQ ID NO: 1831 - DNA, 50 bp, Homo sapiens
atccagccccacccaatggccttttgtgcttgtttcctataacttcagta

SEQ ID NO: 1832 - DNA, 50 bp, Homo sapiens
ccttctttgtatataggcttctcaccgcgaccaataaacagctcccagtt

SEQ ID NO: 1833 - DNA, 50 bp, Homo sapiens
aaaacgatgaaggtatgctgtcatggtcctttctggaagtttctggtgcc

SEQ ID NO: 1834 - DNA, 50 bp, Homo sapiens
aatgcgaaattattggttggtgtgaagaaagccagacaacttctgtttct

SEQ ID NO: 1835 - DNA, 50 bp, Homo sapiens
ctgtggctcgtttgagggattggggtggacctggggtttattttcagtaa

SEQ ID NO: 1836 - DNA, 50 bp, Homo sapiens
gcttccccaccccagtttttgttgcttgaaaatattgttgtcccggattt

SEQ ID NO: 1837 - DNA, 50 bp, Homo sapiens
tggactgttttgttgggcagtgcctgataagcttcaaagctgctttattc

SEQ ID NO: 1838 - DNA, 50 bp, Homo sapiens
cctgccgtgcccacctaactgtccagatgaggtttatcagcttatgagaa

SEQ ID NO: 1839 - DNA, 50 bp, Homo sapiens
cgagctgagaagcggtcatgagcacctggggattttagtaagtgtgtctt

SEQ ID NO: 1840 - DNA, 50 bp, Homo sapiens
accatccaatcggacaagctttcagaaccttattgaaggatttgaagcac

SEQ ID NO: 1841 - DNA, 50 bp, Homo sapiens
tgctgatgaacctgcagaaaaggctgatgaaccaatggaacattaagtga

SEQ ID NO: 1842 - DNA, 50 bp, Homo sapiens
tcttatgcacacggtgatttcatgttatatatgcaaagtaggcaactgtt

SEQ ID NO: 1843 - DNA, 50 bp, Homo sapiens
aacataggagtggattcctgccccaaccaaaccgcattcgtgtggatttt

SEQ ID NO: 1844 - DNA, 50 bp, Homo sapiens
aataaatttgcaaaaccaagatcacagtacaccatatgcactctggtacc

SEQ ID NO: 1845 - DNA, 50 bp, Homo sapiens
aaatgacctcatgttgtggtttaaacagcaactgcacccactagcacagc

SEQ ID NO: 1846 - DNA, 50 bp, Homo sapiens
tgtgcagtagaaacaaaagtaggctacagtctgtgccatgttgatgtaca

SEQ ID NO: 1847 - DNA, 50 bp, Homo sapiens
ctgtttattctgggaaatgttttaatgccagggcctgctgagttgcttct

SEQ ID NO: 1848 - DNA, 50 bp, Homo sapiens
ccttaagaccagttcatagttaatacaggtttacagttcatgcctgtggt

SEQ ID NO: 1849 - DNA, 50 bp, Homo sapiens
tcatcactttggacaggagttaattaagagaatgaccaagctcagttcaa

SEQ ID NO: 1850 - DNA, 50 bp, Homo sapiens
agtctgcctaaataggtagcttaaacttatgtcaaaatgtctgcagcagt

SEQ ID NO: 1851 - DNA, 50 bp, Homo sapiens
ctggcctccagtgccttcccccgtggaataaacggtgtgtcctgagaaac

SEQ ID NO: 1852 - DNA, 50 bp, Homo sapiens
agctaattaagctgcagaacgtgggaaataaagttcgaaacaaaggttaa

SEQ ID NO: 1853 - DNA, 50 bp, Homo sapiens
ggacaggtgtgccgacagaaggaaccagcgtgtatatgagggtatcaaat

SEQ ID NO: 1854 - DNA, 50 bp, Homo sapiens
cccttcgtggggctacacattctcttcctcatattttcatgcacacaagt

SEQ ID NO: 1855 - DNA, 50 bp, Homo sapiens
ttctgcacaggtctctgtttagtaaatacatcactgtataccgatcagga

SEQ ID NO: 1856 - DNA, 50 bp, Homo sapiens
caccctccaccccttccttttgcgcggaccccattacaataaattttaaa

SEQ ID NO: 1857 - DNA, 50 bp, Homo sapiens
catgcagctatttcaaagtgtgttggattaattaggatcatccctttggt

SEQ ID NO: 1858 - DNA, 50 bp, Homo sapiens
tggagaattgtggaaggattgtaacatggaccatccaaatttatggccgt

SEQ ID NO: 1859 - DNA, 50 bp, Homo sapiens
ttcacgggatgcaccaaagtgtgtaccccgtaagcatgaaaccagtgttt

SEQ ID NO: 1860 - DNA, 50 bp, Homo sapiens
tctgtccatcagtgcatgacgtttaaggccacgtatagtcctagctgacg

SEQ ID NO: 1861 - DNA, 50 bp, Homo sapiens
tcctataattatttctgtagcactccacactgatctttggaaacttgccc

SEQ ID NO: 1862 - DNA, 50 bp, Homo sapiens
gggacactggaggctggagctacagttgaaagcactgcatgttaagaggg

SEQ ID NO: 1863 - DNA, 50 bp, Homo sapiens
tgctaccacaactatattatcatgcaaatgctgtattcttctttggtgga

SEQ ID NO: 1864 - DNA, 50 bp, Homo sapiens
gcaacttacgcttggcatcttcagaatgcttttctagcattaagagatgt

SEQ ID NO: 1865 - DNA, 50 bp, Homo sapiens
tttacaagaattgtccatgtgcttccctaggctgagctggcattggtctg

SEQ ID NO: 1866 - DNA, 50 bp, Homo sapiens
aaaacttcccaccctacttttccaagagtgccagttggattctgaatctg

SEQ ID NO: 1867 - DNA, 50 bp, Homo sapiens
tagaccaattctctgatctcgagttgtttttgtttggatacagccctttt

SEQ ID NO: 1868 - DNA, 50 bp, Homo sapiens
aacattctacatagcacaggagcttaagagtggcattatcttctcgcctt

SEQ ID NO: 1869 - DNA, 50 bp, Homo sapiens
agatacgcagacattgtggcatctgggtagaagaatactgtattgtgtgt

SEQ ID NO: 1870 - DNA, 50 bp, Homo sapiens
tttgaccagaagcccttagtaagtacgtgcctgaaactgaaaccatgtgc

SEQ ID NO: 1871 - DNA, 50 bp, Homo sapiens
acacctggcttggagtcagatttagttaacaataatgagcctggagcagt

SEQ ID NO: 1872 - DNA, 50 bp, Homo sapiens
tctaatagcgggttactttcacatacagccctcccccagcagttgaatga

SEQ ID NO: 1873 - DNA, 50 bp, Homo sapiens
ctgaaaagtgctttgctggagtcctgttctctgagctccacagaagacac

SEQ ID NO: 1874 - DNA, 50 bp, Homo sapiens
aagcctaaagtgattcaatagcccaggagcacctgattcctttctgcctg

SEQ ID NO: 1875 - DNA, 50 bp, Homo sapiens
tgggcatggttgaatctgaaaccctccttctgtggcaacttgtactgaaa

SEQ ID NO: 1876 - DNA, 50 bp, Homo sapiens
ggggtggggtggggtgagagtgtgtggagtaaggacattcagaataaata

SEQ ID NO: 1877 - DNA, 50 bp, Homo sapiens
agaagttgtgcgcgtgctttctcagcagcatttttccttcaaaatcatct

SEQ ID NO: 1878 - DNA, 50 bp, Homo sapiens
cttgccagccaggagtgcggacaccatgttcccagctcagtgccaaagag

SEQ ID NO: 1879 - DNA, 50 bp, Homo sapiens
atttggggagagaaaacctttttaagcatggtggggcactcagataggag

SEQ ID NO: 1880 - DNA, 50 bp, Homo sapiens
accctctttcttgtttgtcagcatctgaccatctgtgactataaagctgt

SEQ ID NO: 1881 - DNA, 50 bp, Homo sapiens
tggtcatccaaactcaaacttgagaaaatatcttgctttcaaattgacac

SEQ ID NO: 1882 - DNA, 50 bp, Homo sapiens
accgaatttggcaagaatgaaatggtgtcataaagatgggaggggagggt

SEQ ID NO: 1883 - DNA, 50 bp, Homo sapiens
agcctgtgacattaagcattctcacaattagaaataagaataaaacccat

SEQ ID NO: 1884 - DNA, 50 bp, Homo sapiens
aaaaataaaaacaaatactgtgtttcagaagcgccacctattggggaaaa

SEQ ID NO: 1885 - DNA, 50 bp, Homo sapiens
ttatcacaagctctgttacctttatatacgctgcctcttcaatttggaaa

SEQ ID NO: 1886 - DNA, 50 bp, Homo sapiens
gcagaaaatatcctggcagggaatctggcttaaacatgaaatgctgtaat

SEQ ID NO: 1887 - DNA, 50 bp, Homo sapiens
tgtgtgcataatagctacagtgcatagttgtagacaaagtacattctggg

SEQ ID NO: 1888 - DNA, 50 bp, Homo sapiens
tctcagtgggtggtagcagagggatcaagcagttatttgatttgtgctct

SEQ ID NO: 1889 - DNA, 50 bp, Homo sapiens
gtctatttacggaactcaaatacgtgggcattcaaatgtattacagtggg

SEQ ID NO: 1890 - DNA, 50 bp, Homo sapiens
tgcacttttagaaatgcatatttgccacaaaacctgtattactgaataat

SEQ ID NO: 1891 - DNA, 50 bp, Homo sapiens
gggaggggattaaccaaaggccaccctgactttgtttttgtggacacaca

SEQ ID NO: 1892 - DNA, 50 bp, Homo sapiens
gcctgcccctgtgtattcaccaccaataaatcagaccatgaaacctgaaa

SEQ ID NO: 1893 - DNA, 50 bp, Homo sapiens
aggtgtatttatgttaccgttctgaataaacagaatggaccattgaacca

SEQ ID NO: 1894 - DNA, 50 bp, Homo sapiens
tgtaatgaatttgtcgcaaagacgtaataaaattaactggtggcacggtc

SEQ ID NO: 1895 - DNA, 50 bp, Homo sapiens
tgtcaatggaagttggctgcacttgatgtttgtttgcatgatgtctacct

SEQ ID NO: 1896 - DNA, 50 bp, Homo sapiens
tcgagcacctgtaaacaattttctcaacctatttgatgttcaaataaaga

SEQ ID NO: 1897 - DNA, 50 bp, Homo sapiens
aactttactaagtaatctcacagcatttgccaagtctcccaatatccaat

SEQ ID NO: 1898 - DNA, 50 bp, Homo sapiens
taagatctttaaactgctttatacactgtcacgtggcttcatcagctgtg

SEQ ID NO: 1899 - DNA, 50 bp, Homo sapiens
aaaaccactaccctcagagagagccaaaaatacagaagaggcggagagcg

SEQ ID NO: 1900 - DNA, 50 bp, Homo sapiens
cgagcaagcctgggaactcaggaaaattcacaggacttgggagattctaa

SEQ ID NO: 1901 - DNA, 50 bp, Homo sapiens
ggcttagctacagtgaagttttgcattgcttttgaagacaagaaaagtgc

SEQ ID NO: 1902 - DNA, 50 bp, Homo sapiens
acttcaaaattaccttttcatatccatgatcttgagtccatttgggggat

SEQ ID NO: 1903 - DNA, 50 bp, Homo sapiens
caaacacttttgggccaggatttgagtctctgcatgacatatacttgatt

SEQ ID NO: 1904 - DNA, 50 bp, Homo sapiens
cagactccaccaagcctggtcagcccaaaccaccagaagcccagaataaa

SEQ ID NO: 1905 - DNA, 50 bp, Homo sapiens
agtgcagaatctcataggttgccaataatacactaattcctttctatcct

SEQ ID NO: 1906 - DNA, 50 bp, Homo sapiens
agactgactacattggaagctttgagttgacttctgaccaaaggtggtaa

SEQ ID NO: 1907 - DNA, 50 bp, Homo sapiens; identical to SEQ ID NO: 1761

SEQ ID NO: 1908 - DNA, 50 bp, Homo sapiens
gtggtgagggcagttctgcacccagccaaacacataacaataaaaaccaa

SEQ ID NO: 1909 - DNA, 50 bp, Homo sapiens
tctgtgtcctaaagatgtgttctctataaaatacaaaccaacgtgcctaa

SEQ ID NO: 1910 - DNA, 50 bp, Homo sapiens
ctagtcatagaaatacctcattcgcctgtgggaagagaagggaagcctct

SEQ ID NO: 1911 - DNA, 50 bp, Homo sapiens
agcagcggctggatgtgatatgtctagtttaaccagtccccttgatcttt

SEQ ID NO: 1912 - DNA, 50 bp, Homo sapiens
tattggaggactccctcccagctttggaagggtcatccgcgtgtgtgtgt

SEQ ID NO: 1913 - DNA, 50 bp, Homo sapiens
atacaaagcaaacaaactcaagttatgtcatacctttggatacgaagacc

SEQ ID NO: 1914 - DNA, 50 bp, Homo sapiens; identical to SEQ ID NO: 1575

SEQ ID NO: 1915 - DNA, 50 bp, Homo sapiens; identical to SEQ ID NO: 257

SEQ ID NO: 1916 - DNA, 50 bp, Homo sapiens
gcccaaagaagcaaggaaccaaatttaagactctcgcatcttcccaaccc

SEQ ID NO: 1917 - DNA, 50 bp, Homo sapiens
ccggagtctgggattcatcccgtcatttctttcaataaataattattgga

SEQ ID NO: 1918 - DNA, 50 bp, Homo sapiens
gcaatggcagccttggcaaacgctaaatgaaaatcgtgacaacacttgtg

SEQ ID NO: 1919 - DNA, 50 bp, Homo sapiens
agtgttggtagcacttaagacttatacttgccttctgatagtattccttt

SEQ ID NO: 1920 - DNA, 50 bp, Homo sapiens
aactgaggactgtttgcaattgacataggcaataataagtgatgtgctga

SEQ ID NO: 1921 - DNA, 50 bp, Homo sapiens
gggctcagttctgccttatctaaatcaccagagaccaaacaaggactaat

SEQ ID NO: 1922 - DNA, 50 bp, Homo sapiens; identical to SEQ ID NO: 614

SEQ ID NO: 1923 - DNA, 50 bp, Homo sapiens
tcttggaaacttccattaagtgtgtagattgagcaggtagtaattgcatg

SEQ ID NO: 1924 - DNA, 50 bp, Homo sapiens
actactcagcatggaaacaagatgaaattccatttgtaggtagtgagaca

SEQ ID NO: 1925 - DNA, 50 bp, Homo sapiens
cactaatgatcctgctaccctcttgaagaccagcccggtacctctctccc

SEQ ID NO: 1926 - DNA, 50 bp, Homo sapiens
gtgacctcacttctggcactgtgactactatggctgtttagaactactga

SEQ ID NO: 1927 - DNA, 50 bp, Homo sapiens
aagccttattcttcaactaaaagatgaggattaagagcaagaagttgggg

SEQ ID NO: 1928 - DNA, 50 bp, Homo sapiens
gcactgaatcgtttcatgtaagaatccaaagtggacaccattaacaggtc

SEQ ID NO: 1929 - DNA, 50 bp, Homo sapiens
ggtgctcacattccttaaattaaggagaaatgctggcatagagcagcact

SEQ ID NO: 1930 - DNA, 50 bp, Homo sapiens
cttttgttctctccgtgaaacttacctttccctttttctttctctttttt

SEQ ID NO: 1931 - DNA, 50 bp, Homo sapiens
tggtatgtagagcttagatttccctattgtgacagagccatggtgtgttt

SEQ ID NO: 1932 - DNA, 50 bp, Homo sapiens
tggagataatctagaacacaggcaaaatccttgcttatgacatcacttgt

SEQ ID NO: 1933 - DNA, 50 bp, Homo sapiens
gtgcctctgtgctgtgtatgtgaaccacccatgtgagggaataaacctag

SEQ ID NO: 1934 - DNA, 50 bp, Homo sapiens
tgcaaacggttttgtaagttaacactacactactcacaatggtaggggaa

SEQ ID NO: 1935 - DNA, 50 bp, Homo sapiens
cctgtgcccagcaggaaggaagtcaaataaaccacactgactacctgtgc

SEQ ID NO: 1936 - DNA, 50 bp, Homo sapiens
cccaacaatcccaaggccctttttatacaaaaattctcagttctcttcac

SEQ ID NO: 1937 - DNA, 50 bp, Homo sapiens
tgtctgttttaatcatgtatctggaatagggtcgggaagggtttgtgcta

SEQ ID NO: 1938 - DNA, 50 bp, Homo sapiens
cacgatggtggaaacagtggggaactactgctggaaaaagccctaatagc

SEQ ID NO: 1939 - DNA, 50 bp, Homo sapiens
ccctggaggcactgaagtgcttagtgtacttggagtattggggtctgacc

SEQ ID NO: 1940 - DNA, 50 bp, Homo sapiens
acaagtttacatgataaaaagaaatgtgatttgtcttcccttctttgcac

SEQ ID NO: 1941 - DNA, 50 bp, Homo sapiens
ttgtatgtgaataattctagcgggggacctgggagataattctacgggga

SEQ ID NO: 1942 - DNA, 50 bp, Homo sapiens
atctattctaacgcaaaaccactaactgaagttcagatataatggatggt

SEQ ID NO: 1943 - DNA, 50 bp, Homo sapiens
gtaacggaacatatccagtactcctggttcctaggtgagcaggtgatgcc

SEQ ID NO: 1944 - DNA, 50 bp, Homo sapiens
actaatttgatgtttacaggtggacacacaaggtgcaaatcaatgcgtac

SEQ ID NO: 1945 - DNA, 50 bp, Homo sapiens
tgtgtgttttagtttcatcacctgttatctgtgtttgctgaggagagtgg

SEQ ID NO: 1946 - DNA, 50 bp, Homo sapiens
ttggagctgttccattgggtcctcttggtgtcgtttccctcccaacagag

SEQ ID NO: 1947 - DNA, 50 bp, Homo sapiens
atttgttgctctcagactgtgtaaaacaaaatttattcatgttttctgca

SEQ ID NO: 1948 - DNA, 50 bp, Homo sapiens
ctgaaccattactgtaattggctcttaaggcttgaagtaaccttataggt

SEQ ID NO: 1949 - DNA, 50 bp, Homo sapiens
gctaagctgccggttcttaaatccatcctgctaagttaatgttgggtaga

SEQ ID NO: 1950 - DNA, 50 bp, Homo sapiens
tgtaaccaataaatctgtagtgaccttacctgtattccctgtgctatcct

SEQ ID NO: 1951 - DNA, 50 bp, Homo sapiens; identical to SEQ ID NO: 305

SEQ ID NO: 1952 - DNA, 50 bp, Homo sapiens
atttctcccttatctactgtgatgacttcagaagatacaatggtcccagg

SEQ ID NO: 1953 - DNA, 50 bp, Homo sapiens
tgtctggagggggtttgtgcctgataacgtaataacaccagtggagactt

SEQ ID NO: 1954 - DNA, 50 bp, Homo sapiens
acactgccttctcaactccaaactgactcttaagaagactgcattatatt

SEQ ID NO: 1955 - DNA, 50 bp, Homo sapiens
agatgttccaaatttagaaagcttaaggcggcctacagaaaaaggaaaaa

SEQ ID NO: 1956 - DNA, 50 bp, Homo sapiens
aagtccaactactaaactgggggatattatgaagggccttgagcatctgg

SEQ ID NO: 1957 - DNA, 50 bp, Homo sapiens
atccacctccctcccctagagctattctcctttgggtttcttgctgctgc

SEQ ID NO: 1958 - DNA, 50 bp, Homo sapiens
aaaaggccacagcaatctgtactacaatcaactttattttgaaatcatgt

SEQ ID NO: 1959 - DNA, 50 bp, Homo sapiens
gattagttaccattgaaattggttctgtcataaaacagcatgagtctggt

SEQ ID NO: 1960 - DNA, 50 bp, Homo sapiens
aaaaatacacatcacacccatttaaaagtgatcttgagaaccttttcaaa

SEQ ID NO: 1961 - DNA, 50 bp, Homo sapiens
acagcaacagctattaaatcagcaagttttggagcaaagacaacagcagt

SEQ ID NO: 1962 - DNA, 50 bp, Homo sapiens
tgaccagggcagtgaaaatgaaaccgcattttgggtgccattaaataggg

SEQ ID NO: 1963 - DNA, 50 bp, Homo sapiens
caatttctttattagagggccttattgatgtgttctaagtctttccagaa

SEQ ID NO: 1964 - DNA, 50 bp, Homo sapiens
agagctgaaatgtcaggaacaaaaagaagaacagctgcaggaaggggtgc

SEQ ID NO: 1965 - DNA, 50 bp, Homo sapiens
ggtaataagagcagtagcagcagcatctctgaacatttctctggatttgc

SEQ ID NO: 1966 - DNA, 50 bp, Homo sapiens
agagtttggaaaaagcctgtgaaaggtgtcttctttgacttaatgtcttt

SEQ ID NO: 1967 - DNA, 50 bp, Homo sapiens
gtatggtagattcaaatgaaccactgaaaaggcatttagtttcttgtccc

SEQ ID NO: 1968 - DNA, 50 bp, Homo sapiens; identical to SEQ ID NO: 1762

SEQ ID NO: 1969 - DNA, 50 bp, Homo sapiens
gctcttaagttgtggagagtgcaacagtagcataggaccctaccctctgg

SEQ ID NO: 1970 - DNA, 50 bp, Homo sapiens; identical to SEQ ID NO: 658

SEQ ID NO: 1971 - DNA, 50 bp, Homo sapiens
aaaacagccaaaactccacagtcaatattagtaatttcttgctggttgaa

SEQ ID NO: 1972 - DNA, 50 bp, Homo sapiens
tagcatttgtttaagggtgatagtcaaattatgtattggtggggctgggt

SEQ ID NO: 1973 - DNA, 50 bp, Homo sapiens
gcagatgagacagcaaccattgtagaatttctgaacagatggattacctt

SEQ ID NO: 1974 - DNA, 50 bp, Homo sapiens
tctaatttctgaaatgtgcagctcccatttggccttgtgcggttgtgttc

SEQ ID NO: 1975 - DNA, 50 bp, Homo sapiens
accagagtacgttggaaaacttcttggaaaggctaaagacgatcatgaga

SEQ ID NO: 1976 - DNA, 50 bp, Homo sapiens
tgaggacttttcgaccaattcaaccctttgccccacctttattaaaatct

SEQ ID NO: 1977 - DNA, 50 bp, Homo sapiens
gctggcccataaacaccctgtaggttcttgatatttataataaaattggt

SEQ ID NO: 1978 - DNA, 50 bp, Homo sapiens
cccagggagttgtgtctgtaatcggcctactattcagtggcgagaaataa

SEQ ID NO: 1979 - DNA, 50 bp, Homo sapiens; identical to SEQ ID NO: 1810

SEQ ID NO: 1980 - DNA, 50 bp, Homo sapiens
ttgttgacaactgtgactgtacccaaatggaaagtaactcatttgttaaa

SEQ ID NO: 1981 - DNA, 50 bp, Homo sapiens
gtcaagattgtgttttgaggtttccttcagacagattccaggcgatgtgc

SEQ ID NO: 1982 - DNA, 50 bp, Homo sapiens
tcaccagtccctccccaaatgctttccatgagttgcagttttttcctagt

SEQ ID NO: 1983 - DNA, 50 bp, Homo sapiens
tactttggggacttgtagggatgcctttctagtcctattctattgcagtt

SEQ ID NO: 1984 - DNA, 50 bp, Homo sapiens
ccatcggtgaaactaacagataagcaagagagatgttttggggactcatt

SEQ ID NO: 1985 - DNA, 50 bp, Homo sapiens; identical to SEQ ID NO: 1781

SEQ ID NO: 1986 - DNA, 50 bp, Homo sapiens
caccaggaacctgctttagtgggggatagtgaagaagacaataaaagata

SEQ ID NO: 1987 - DNA, 50 bp, Homo sapiens
ggctacagaaagaagatgccagatgacacttaagacctacttgtgatatt

SEQ ID NO: 1988 - DNA, 50 bp, Homo sapiens
gcatttccacaccaagcagcaacagcaaatcacgaccactgatagatgtc

SEQ ID NO: 1989 - DNA, 50 bp, Homo sapiens
tccccaaaccataaaaccctatacaagttgttctagtaacaatacatgag

SEQ ID NO: 1990 - DNA, 50 bp, Homo sapiens
gcttccggtccttagccttcccaggtgggactttaggcatgattaaaata

SEQ ID NO: 1991 - DNA, 50 bp, Homo sapiens
tgctattgccttcctattttgcataataaatgcttcagtgaaaatgcagc

SEQ ID NO: 1992 - DNA, 50 bp, Homo sapiens
ggaagaagagggagagatggagcaaagtgagggccgagtgagagcgtgct

SEQ ID NO: 1993 - DNA, 50 bp, Homo sapiens; identical to SEQ ID NO: 1831

SEQ ID NO: 1994 - DNA, 50 bp, Homo sapiens
ctcagctaaaaggccacccctttatcgcattgctgtccttgggtagaata

SEQ ID NO: 1995 - DNA, 50 bp, Homo sapiens
accttatgaactacagtggagctacactcattgaaatgtaatttcagttc

SEQ ID NO: 1996 - DNA, 50 bp, Homo sapiens; identical to SEQ ID NO: 32

SEQ ID NO: 1997 - DNA, 50 bp, Homo sapiens
gccagatttggggcatttggaaagaagttcattgaagataaagcaaaagt

SEQ ID NO: 1998 - DNA, 50 bp, Homo sapiens
ctgcacccttcccccagcaccatttatgagtctcaagttttattattgca

SEQ ID NO: 1999 - DNA, 50 bp, Homo sapiens
ttttgaagaagggaaattcacactgtgcgttttgagtatgcaagaagaat

SEQ ID NO: 2000 - DNA, 50 bp, Homo sapiens
tgttgtgactttttagccagtgactttttctgagcttttcatggaagtgg

SEQ ID NO: 2001 - DNA, 50 bp, Homo sapiens
acttcacacagacaagtggctaagtgtccattatttaccttgaacaatca

SEQ ID NO: 2002 - DNA, 50 bp, Homo sapiens; identical to SEQ ID NO: 433

SEQ ID NO: 2003 - DNA, 50 bp, Homo sapiens; identical to SEQ ID NO: 1787

SEQ ID NO: 2004 - DNA, 50 bp, Homo sapiens
atggaaattgtatttgccttctccactttgggaggctcccacttcttggg

SEQ ID NO: 2005 - DNA, 50 bp, Homo sapiens
tcagagggaaagtaaatatttcaggcatactgacactttgccagaaagca

SEQ ID NO: 2006 - DNA, 50 bp, Homo sapiens
gtgtaacacagtgccttcaataaatggtatagcaaatgttttgacatgaa

SEQ ID NO: 2007 - DNA, 50 bp, Homo sapiens
tgggactattacatccacatgatacctctgatcaagtatttttgacattt

SEQ ID NO: 2008 - DNA, 50 bp, Homo sapiens
cattcgtatgagaagcggcttttctgaaaagggatccagcacacctcctc

SEQ ID NO: 2009 - DNA, 50 bp, Homo sapiens
cttcagactgaacatgtacactggtttgagcttagtgaaatgacttccgg

SEQ ID NO: 2010 - DNA, 50 bp, Homo sapiens
tttaaatgtttgtgttaatacacattaaaacatcgcacaaaaacgatgca

SEQ ID NO: 2011 - DNA, 50 bp, Homo sapiens
gcaaccttgcatccatctgggctaccccacccaagtatacaataaagtct

SEQ ID NO: 2012 - DNA, 50 bp, Homo sapiens
tgctggtggggaaagacttaaaagtggattaaagacctgcgtattgatga

SEQ ID NO: 2013 - DNA, 50 bp, Homo sapiens
aggggcgctcgcttccgcatcctagtctctatcattaaagttctagtgac

SEQ ID NO: 2014 - DNA, 50 bp, Homo sapiens
agctgatcctcgggaagaacaaagctaaagctgccttttgtctgttattt

SEQ ID NO: 2015 - DNA, 50 bp, Homo sapiens
cacaggcccatggactcacttttgtaacaaactcctaccaacactgacca

SEQ ID NO: 2016 - DNA, 50 bp, Homo sapiens
aggaggagtttctattaaaatctgtcacttgagtgatgtcatttaagtcc

SEQ ID NO: 2017 - DNA, 50 bp, Homo sapiens
cctgtgcaatagacacatacatgtcacatttagctgtgctcagaagggct

SEQ ID NO: 2018 - DNA, 50 bp, Homo sapiens; identical to SEQ ID NO: 2017

SEQ ID NO: 2019 - DNA, 50 bp, Homo sapiens
tgcacctgttactgttgggctttccactgagatctactggataaagaata

SEQ ID NO: 2020 - DNA, 50 bp, Homo sapiens
aagaaggagcttaatgccaggaacagattttgcagttggtggggtctcaa

SEQ ID NO: 2021 - DNA, 50 bp, Homo sapiens
agggctacctgcgatctgtgtttgctctgacgaatggaatttatcctcac

SEQ ID NO: 2022 - DNA, 50 bp, Homo sapiens
ccatgattatttttctaagctggttggttaataaacagtacctgctctca

SEQ ID NO: 2023 - DNA, 50 bp, Homo sapiens
aaaggctaaagaacttgccactaaactgggttaaatgtacactgttgagt

SEQ ID NO: 2024 - DNA, 50 bp, Homo sapiens
ggaaccaagactgtgcaggagaaagagaactagtgctgagggcctcaata

SEQ ID NO: 2025 - DNA, 50 bp, Homo sapiens
tggttccagcagaagtatgatgggatcatccttcctggcaaataaattcc

SEQ ID NO: 2026 - DNA, 50 bp, Homo sapiens
ttggttgtttggttagtgactgatgtaaaacggttttcttgtggggaggt

SEQ ID NO: 2027 - DNA, 50 bp, Homo sapiens
atgctggcagcattgcatgattctccagtatatttgtaaaaaataaaaaa

SEQ ID NO: 2028 - DNA, 50 bp, Homo sapiens
cgggccagccgaggctacaaaaactaaccctggatcctactctcttatta

SEQ ID NO: 2029 - DNA, 50 bp, Homo sapiens; identical to SEQ ID NO: 106

SEQ ID NO: 2030 - DNA, 50 bp, Homo sapiens
ttcaactaaagcgccacctgctccacccagagaagcacactttgtgagaa

SEQ ID NO: 2031 - DNA, 50 bp, Homo sapiens
ttggaaatcatagtcaaagggcttccttggttcgccactcatttatttgt

SEQ ID NO: 2032 - DNA, 50 bp, Homo sapiens; identical to SEQ ID NO: 2031

SEQ ID NO: 2033 - DNA, 50 bp, Homo sapiens
cctgatggagagaagaaggcatatgttcgactggctcctgattacgatgc

SEQ ID NO: 2034 - DNA, 50 bp, Homo sapiens
cagaagaaactgaagaaacaaaaacttatggcacgggagtaaattcagca

SEQ ID NO: 2035 - DNA, 50 bp, Homo sapiens
gtttcagctccccgagttggtggaaaacgctaaactggcagattagattt

SEQ ID NO: 2036 - DNA, 50 bp, Homo sapiens
ctcctgttgggtaagggtgttgagtgtgacttgtgctgaaaacctggttc

SEQ ID NO: 2037 - DNA, 50 bp, Homo sapiens
gaacaagtggttcttccagaaactgcggttttagatgctttgttttgatc

SEQ ID NO: 2038 - DNA, 50 bp, Homo sapiens
ggcttgaagccacatggagggagtttcattaaatgctaactacttttaaa

SEQ ID NO: 2039 - DNA, 50 bp, Homo sapiens
atctacagacagtcaatgtggatgagaactaatcgctgatcaaataacgt

SEQ ID NO: 2040 - DNA, 50 bp, Homo sapiens
gcgcagtgaagaaaatgagtaggcagctcatgtgcacgttttctgtttaa

SEQ ID NO: 2041 - DNA, 50 bp, Homo sapiens
caatcttcctgctaaggccattggacacagaatccgagtgatgctgtacc

SEQ ID NO: 2042 - DNA, 50 bp, Homo sapiens
ggcagctgttgcagcatccagttcatcttaagaatgtcaacgattagtca

SEQ ID NO: 2043 - DNA, 50 bp, Homo sapiens
agacgctcctctactctttggagacatcactggcctataataaatgggtt

SEQ ID NO: 2044 - DNA, 50 bp, Homo sapiens
tctgttatgaacacgttggttggctggattcagtaataaatatgtaaggc

SEQ ID NO: 2045 - DNA, 50 bp, Homo sapiens
tgagaagaaggaggagtctgaagagtcagatgatgacatgggatttggcc

SEQ ID NO: 2046 - DNA, 50 bp, Homo sapiens
gctaaagttgaacgagctgatggatatgaaccaccagtccaagaatctgt

SEQ ID NO: 2047 - DNA, 50 bp, Homo sapiens
gctggccaccaaacagagcagtggctaaattgcagtagcagcatatcttt

SEQ ID NO: 2048 - DNA, 50 bp, Homo sapiens
gccaagtccaaccgctgattttcccagctgctgcccaataaacctgtctg

SEQ ID NO: 2049 - DNA, 50 bp, Homo sapiens
tggtgtctataagaagctcacgggcaaggatgttaattttgaattcccag

SEQ ID NO: 2050 - DNA, 50 bp, Homo sapiens; identical to SEQ ID NO: 78

SEQ ID NO: 2051 - DNA, 50 bp, Homo sapiens
catctacagcctctgccctggtcgcataaatttgtctgtgtactcaagca

SEQ ID NO: 2052 - DNA, 50 bp, Homo sapiens
ctaccagaaatcctaccgataagcccatcgtgactcaaaactcacttgta

SEQ ID NO: 2053 - DNA, 50 bp, Homo sapiens
ctcggggacctgtttgaattttttctgtagtgctgtattattttcaataa

SEQ ID NO: 2054 - DNA, 50 bp, Homo sapiens
gctgccaacaagaagcattagaacaaaccatgctgggttaataaattgcc

SEQ ID NO: 2055 - DNA, 50 bp, Homo sapiens
gatggcatcgtctcaaagaacttttgactggagagaatcacagatgtgga

SEQ ID NO: 2056 - DNA, 50 bp, Homo sapiens; identical to SEQ ID NO: 2055

SEQ ID NO: 2057 - DNA, 50 bp, Homo sapiens
ccaatgtttctcttttggccctatacaaaggcaagaaggaaagaccaaga

SEQ ID NO: 2058 - DNA, 50 bp, Homo sapiens
ctggcaaaaagccgaaggagtaaaggtgctgcaatgatgttagctgtggc

SEQ ID NO: 2059 - DNA, 50 bp, Homo sapiens
tggtgaagatgcatgaataggtccaaccagctgtacatttggaaaaataa

SEQ ID NO: 2060 - DNA, 50 bp, Homo sapiens
gccagtgtttccgtcagtacgcgaaggatatcggtttcattaagttggac

SEQ ID NO: 2061 - DNA, 50 bp, Homo sapiens
gagtgataactcatgagaagtactgataggacctttatctggatatggtc

SEQ ID NO: 2062 - DNA, 50 bp, Homo sapiens
ggtgattcttctctgttgaactgaagtttgtgagagtagttttcctttgc

SEQ ID NO: 2063 - DNA, 50 bp, Homo sapiens; identical to SEQ ID NO: 1804

SEQ ID NO: 2064 - DNA, 50 bp, Homo sapiens
ggggaaggtgtttttagtacaagacatcaaagtgaagtaaagcccaagtg

SEQ ID NO: 2065 - DNA, 50 bp, Homo sapiens
aggaaaacatccaaaacaacaagcaagaaaccgaagaagacatcttttga

SEQ ID NO: 2066 - DNA, 50 bp, Homo sapiens
agctgccacctcagtctcttctctgtattatcatagtctggtttaaataa

SEQ ID NO: 2067 - DNA, 50 bp, Homo sapiens
ggaggcagccagggcttacctgtacactgacttgagaccagttgaataaa

SEQ ID NO: 2068 - DNA, 50 bp, Homo sapiens
agcaaagatttcagtagaattttagtcctgaacgctacggggaaaatgca

SEQ ID NO: 2069 - DNA, 50 bp, Homo sapiens
tggtggtattcagtggtccaggattctgtaatgctttacacaggcagttt

SEQ ID NO: 2070 - DNA, 50 bp, Homo sapiens
tgcttttatgtgtcccttgataacagtgacttaacaatatacattcctca

SEQ ID NO: 2071 - DNA, 50 bp, Homo sapiens
ttgtttcaaaatgctgtttcatttttataaagtaccagtgtttagctgct

SEQ ID NO: 2072 - DNA, 50 bp, Homo sapiens
agagatggacaagagcagccaggagacccagcgatctgagcataaaactc

SEQ ID NO: 2073 - DNA, 50 bp, Homo sapiens
tgaaagagaaagactgattacctcctgtgtggaagaaggaaacaccgagt

SEQ ID NO: 2074 - DNA, 50 bp, Homo sapiens
ggaatacctcagaagagatgcttcattgagtgttcattaaaccacacatg

SEQ ID NO: 2075 - DNA, 50 bp, Homo sapiens
accatgatactttaattagaagcttagccttgaaattgtgaactcttgga

SEQ ID NO: 2076 - DNA, 50 bp, Homo sapiens; identical to SEQ ID NO: 2075

SEQ ID NO: 2077 - DNA, 50 bp, Homo sapiens
gcctctgccctggtttggctatgtcagatccaataaacatcctgaacctc

SEQ ID NO: 2078 - DNA, 50 bp, Homo sapiens
tgccttttctaccccatccctcacagcctcttgctgctaaaatagatgtt

SEQ ID NO: 2079 - DNA, 50 bp, Homo sapiens
ggccaggcccaagtaagtgtaccttgtactttataaataaacctcaagca

SEQ ID NO: 2080 - DNA, 50 bp, Homo sapiens
gccgaattgtctttggtgcttttcacttgtgttttaaaataaggattttt

SEQ ID NO: 2081 - DNA, 50 bp, Homo sapiens; identical to SEQ ID NO: 1720

SEQ ID NO: 2082 - DNA, 50 bp, Homo sapiens
agaagtcccccatgtggatatttcttatactaattgtatcataaagccgt

SEQ ID NO: 2083 - DNA, 50 bp, Homo sapiens
gggcaggagcatggggtgcttggttgtttccttcctaataaaataaacgc

SEQ ID NO: 2084 - DNA, 50 bp, Homo sapiens
atgcatttggtatgaatctgtggttgtatctgttcaattctaaagtacaa

SEQ ID NO: 2085 - DNA, 50 bp, Homo sapiens
ttctctaggttactgttgggagcttaatggtagaaacttccttggtttca

SEQ ID NO: 2086 - DNA, 50 bp, Homo sapiens
cctcccagcaacccactacctctggtacctgtaaaggtcaaacaagaaac

SEQ ID NO: 2087 - DNA, 50 bp, Homo sapiens
ccgtgtctgtttgtaggcggagaaaccgttgggtaacttgttcaagatat

SEQ ID NO: 2088 - DNA, 50 bp, Homo sapiens
tgagggtgagggcaggctgaggcaacgagtgggaggttcaaacaagagtg

SEQ ID NO: 2089 - DNA, 50 bp, Homo sapiens
cccaaacaatctgtggatggaaaagcaccacttgctactggagaggatga

SEQ ID NO: 2090 - DNA, 50 bp, Homo sapiens
aatcaacttcaaggagcaccttcattagtacagcttgcatatttaacatt

SEQ ID NO: 2091 - DNA, 50 bp, Homo sapiens
aggcgatgatattctcaccatcctgactgaagtgaactatgaagtaagca

SEQ ID NO: 2092 - DNA, 50 bp, Homo sapiens
tgacgacctggtagaatctctctaaccatttgaagttgatttctcaatgc

SEQ ID NO: 2093 - DNA, 50 bp, Homo sapiens
gctgcgaaagacccacatgctacaagacgggcaaaataaagtgacagatg

SEQ ID NO: 2094 - DNA, 50 bp, Homo sapiens
cgcccatgatgggagggattgacatgtttcaacaaaataatgcacttcct

SEQ ID NO: 2095 - DNA, 50 bp, Homo sapiens
tctttcagatagcaggcagggaagcaatgtagtgtggtgggcagagcccc

SEQ ID NO: 2096 - DNA, 50 bp, Homo sapiens
caggaggatggcaaagagagtcgcatctcagtgcaggagagacagtgagg

SEQ ID NO: 2097 - DNA, 50 bp, Homo sapiens
gggggtagtggtggcaggacaagagaaggcattgagctttttctttcatt

SEQ ID NO: 2098 - DNA, 50 bp, Homo sapiens
gccatgaaggagcaagttttgtatttgtgacctcagctttgggaataaag

SEQ ID NO: 2099 - DNA, 50 bp, Homo sapiens; identical to SEQ ID NO: 621

SEQ ID NO: 2100 - DNA, 50 bp, Homo sapiens
accaagtttcaggggacatgagttttccagcttttatacacacgtatctc

SEQ ID NO: 2101 - DNA, 50 bp, Homo sapiens
ggcaaatgaggaacagggcaatagtatgatgaatcttgattggagttggt

SEQ ID NO: 2102 - DNA, 50 bp, Homo sapiens; identical to SEQ ID NO: 165

SEQ ID NO: 2103 - DNA, 50 bp, Homo sapiens
tataccatgagatgagatgaccaccaatcatttccttggggggagggggt

SEQ ID NO: 2104 - DNA, 50 bp, Homo sapiens
cctaggaaatcacaggcttctgagcacagctgcattaaaacaaaggaagt

SEQ ID NO: 2105 - DNA, 50 bp, Homo sapiens
aaatgtaaccttttgctttccaaattaaagaactccatgccactcctcaa

SEQ ID NO: 2106 - DNA, 50 bp, Homo sapiens
acacacatacacacaccccaaaacacatacattgaaagtgcctcatctga

SEQ ID NO: 2107 - DNA, 50 bp, Homo sapiens
gaccctatcctcccaccgcctccgttaacacgatcctgaataaatcttga

SEQ ID NO: 2108 - DNA, 50 bp, Homo sapiens
acagcaaagcccattggccagaaaggaaagacaataattttgttttttca

SEQ ID NO: 2109 - DNA, 50 bp, Homo sapiens
aaggagtaaagatttgcctttaaataacttggtattttcctggctttcgt

SEQ ID NO: 2110 - DNA, 50 bp, Homo sapiens
ggcctcgtttacttttaaaaaatgaaattgttcattgctgggagaagaat

SEQ ID NO: 2111 - DNA, 50 bp, Homo sapiens
tcaactaatgatttagtgatcaaattgtgcagtactttgtgcattctgga

SEQ ID NO: 2112 - DNA, 50 bp, Homo sapiens
taggtttctgacttttgtggatcattttgcacatagctttatcaactttt

SEQ ID NO: 2113 - DNA, 50 bp, Homo sapiens
aaatcagtactttttaatggaaacaacttgacccccaaatttgtcacaga

SEQ ID NO: 2114 - DNA, 50 bp, Homo sapiens; identical to SEQ ID NO: 88

SEQ ID NO: 2115 - DNA, 50 bp, Homo sapiens
caggaggggggagggaagggagccaagggatggacatcttgtcatttttt

SEQ ID NO: 2116 - DNA, 50 bp, Homo sapiens
gcaagtatgctgctctctctgttgatggtgaagatgaaaatgagggagaa

SEQ ID NO: 2117 - DNA, 50 bp, Homo sapiens
ttgtgggtgtgaaacaaatggtgagaatttgaattggtccctcctattat

SEQ ID NO: 2118 - DNA, 50 bp, Homo sapiens
aaagggaaaaagacctcgtggagaatttttactggggattcttgaacttg

SEQ ID NO: 2119 - DNA, 50 bp, Homo sapiens
aaatgtatttactatgcgtgtttccagcagttggcattaaagtgcctttt

SEQ ID NO: 2120 - DNA, 50 bp, Homo sapiens
atttgcattactctggtggattgttctagtactgtattgggcttcttcgt

SEQ ID NO: 2121 - DNA, 50 bp, Homo sapiens
gaggaggtctcttctatgccaccggcctctgccagctttgcaccagcgtg

SEQ ID NO: 2122 - DNA, 50 bp, Homo sapiens; identical to SEQ ID NO: 1465

SEQ ID NO: 2123 - DNA, 50 bp, Homo sapiens
tttgaagagccattttggtaaacggtttttattaaagatgctatggaaca

SEQ ID NO: 2124 - DNA, 50 bp, Homo sapiens
gtcaggattgcgagagatgtgtgttgatactgttgcacgtgtgtttttct

SEQ ID NO: 2125 - DNA, 50 bp, Homo sapiens; identical to SEQ ID NO: 1857

SEQ ID NO: 2126 - DNA, 50 bp, Homo sapiens
taatggccccttaccctgggtgaagcacttacccttggaacagaactcta

SEQ ID NO: 2127 - DNA, 50 bp, Homo sapiens
aaggcctcatcctggggaggatacgtaggcacacagaggggagtcaccag

SEQ ID NO: 2128 - DNA, 50 bp, Homo sapiens
tggggtaagtggagttgggaaatacaagaagagaaagaccagtggggatt

SEQ ID NO: 2129 - DNA, 50 bp, Homo sapiens
acctagcggacaatgatggagagatctatgatgatattgctgatggctgc

SEQ ID NO: 2130 - DNA, 50 bp, Homo sapiens
gtgatggtgtagccctcccactttgctgttccttactttactgcctgaat

SEQ ID NO: 2131 - DNA, 50 bp, Homo sapiens
gcctctacttctgtctcaaaatggctccaaatgatttctgtactgcaaaa

SEQ ID NO: 2132 - DNA, 50 bp, Homo sapiens
tctccttccacagtttatttcctcgcttcctttgcatctaaacctttctt

SEQ ID NO: 2133 - DNA, 50 bp, Homo sapiens
acactgttgccctggctgtattcataagattccagctccttcaggtgttt

SEQ ID NO: 2134 - DNA, 50 bp, Homo sapiens
gtcaatattctgcaatttcagccccatttgtactacgtgcgagacagcct

SEQ ID NO: 2135 - DNA, 50 bp, Homo sapiens
ggcgggactgggcggggcggggcatcagaactcaggtgttttttatttac

SEQ ID NO: 2136 - DNA, 50 bp, Homo sapiens
ttccttttgctctttgtggttggatctaacactaactgtattgttttgtt

SEQ ID NO: 2137 - DNA, 50 bp, Homo sapiens
acgtcttccaaataaattatgtgttggtgccatcgcacatgctcaataaa

SEQ ID NO: 2138 - DNA, 50 bp, Homo sapiens; identical to SEQ ID NO: 1705

SEQ ID NO: 2139 - DNA, 50 bp, Homo sapiens
ctgagactggctgctgactttgagaactctgtgagacaaggtccttaggc

SEQ ID NO: 2140 - DNA, 50 bp, Homo sapiens
gcagggaagctttgcatgttgctctaaggtacatttttaaagagttgttt

SEQ ID NO: 2141 - DNA, 50 bp, Homo sapiens
cgaaccaaagctagaagcaaatgtcgagataagagagcagatgttggaga

SEQ ID NO: 2142 - DNA, 50 bp, Homo sapiens
ggaaggaaaagagtgctgagaaatggctctgtataatctatggctatccg

SEQ ID NO: 2143 - DNA, 50 bp, Homo sapiens
accaaggctagaaccacctgcctatattttttgttaaatgatttcattca

SEQ ID NO: 2144 - DNA, 50 bp, Homo sapiens
cctctgccaaagtactcttaggtgccagtctggtaactgaactccctctg

SEQ ID NO: 2145 - DNA, 50 bp, Homo sapiens
aaaataatgcaccacttttaacagaacagacagatgaggacagagctggt

SEQ ID NO: 2146 - DNA, 50 bp, Homo sapiens
gaattgggggatagatctataatgttcactgttcaaaacgaagactagct

SEQ ID NO: 2147 - DNA, 50 bp, Homo sapiens
ccgtttgctttcagaaaatgttttagggtaaatgcataagactatgcaat

SEQ ID NO: 2148 - DNA, 50 bp, Homo sapiens
cccaaattctttcagtggctacctacatacaattccaaacacatacagga

SEQ ID NO: 2149 - DNA, 50 bp, Homo sapiens
aaattaataagtcacaagaaaaacaaaagtgccagaagatgtccagccac

SEQ ID NO: 2150 - DNA, 50 bp, Homo sapiens
agaggctcctaactgggcaactcaagattctggcttctactgaagaacca

SEQ ID NO: 2151 - DNA, 50 bp, Homo sapiens
ggttttctactgttatgtgagaacattaggccccagcaacacgtcattgt

SEQ ID NO: 2152 - DNA, 50 bp, Homo sapiens
cagcttctgccacttcccaggtaagcaggaggaggtgccaacagtgttag

SEQ ID NO: 2153 - DNA, 50 bp, Homo sapiens
accatttttgttactctcttccacatgttactggataaattgtttagtgg

SEQ ID NO: 2154 - DNA, 50 bp, Homo sapiens
gtgccactaacggttgagttttgactgcttggaactggaatcctttcagc

SEQ ID NO: 2155 - DNA, 50 bp, Homo sapiens
tctccaccaccatctcccctctacttctcatttcctaactctctgctgaa

SEQ ID NO: 2156 - DNA, 50 bp, Homo sapiens
ggtgttggacttaaatcagttgaaatgtatttctgtaccacaatttacgc

SEQ ID NO: 2157 - DNA, 50 bp, Homo sapiens
cccttccgctgttcctgaaataacctttcataaagtgctttgggtgccat

SEQ ID NO: 2158 - DNA, 50 bp, Homo sapiens
ttctcatgtataaaactaggaatcctccaaccaggctcctgtgatagagt

SEQ ID NO: 2159 - DNA, 50 bp, Homo sapiens
agacacgtctatcagcttattccttctctactggaatattggtatagtca

SEQ ID NO: 2160 - DNA, 50 bp, Homo sapiens
tgtctggtaacaagatgtgactttttggtagcactgttgtggttcattct

SEQ ID NO: 2161 - DNA, 50 bp, Homo sapiens
tcctctttccagtggatcataagacaatggaccctttttgttatgatggt

SEQ ID NO: 2162 - DNA, 50 bp, Homo sapiens
actgttttgtatacttgttttcagttttcatttcgacaaacaagcactgt

SEQ ID NO: 2163 - DNA, 50 bp, Homo sapiens
acatagtttttatttttgtgtctgtgaaagtgccaagaacccctccccac

SEQ ID NO: 2164 - DNA, 50 bp, Homo sapiens
tcacctggacttaagcgtctggctctaattcacagtgctctttctcctca

SEQ ID NO: 2165 - DNA, 50 bp, Homo sapiens
agatgcctggcagggctgggtggcgattcataaagacctcgtgttgattc

SEQ ID NO: 2166 - DNA, 50 bp, Homo sapiens
ggatagtcaggagcgtcaatgtgcttgtacatagagtgctgtagctgtgt

SEQ ID NO: 2167 - DNA, 50 bp, Homo sapiens
ttgtgaaatatcttgttactgcttttatttagcagactgtggactgtaat

SEQ ID NO: 2168 - DNA, 50 bp, Homo sapiens
ctggaggacctgttgatgctagttcagagtatcaccaagagctggagagg

SEQ ID NO: 2169 - DNA, 50 bp, Homo sapiens
gctgcacaagagccttgattgaagatatattctttctgaacagtatttaa

SEQ ID NO: 2170 - DNA, 50 bp, Homo sapiens
ttgcctttataaaaacttgctgcctgactaaagattaacaggttatagtt

SEQ ID NO: 2171 - DNA, 50 bp, Homo sapiens
tggttctgctttttgacctctctctaccttttcagggtaatctttgtggc

SEQ ID NO: 2172 - DNA, 50 bp, Homo sapiens
cctgtccttgtgtttgtgtgtgctaacagaaataagttgcagtatggtcg

SEQ ID NO: 2173 - DNA, 50 bp, Homo sapiens
aaaagtgttggttttctgccatcagtgaaaattcttaaacttggagcaac

SEQ ID NO: 2174 - DNA, 50 bp, Homo sapiens
agggtttggctgtgtctaaactgcattaccgcgttgtaaaaaatagctgt

SEQ ID NO: 2175 - DNA, 50 bp, Homo sapiens
cctaggctgcgctccagcactgcggggcttttctgcaataaagtcacgag

SEQ ID NO: 2176 - DNA, 50 bp, Homo sapiens
ggcagcacagagacccccggaacaagcctaaaaattgtttcaaaataaaa

SEQ ID NO: 2177 - DNA, 50 bp, Homo sapiens
aagtcttttccacaaaccaccatctattttgtgaactttgttagtcatct

SEQ ID NO: 2178 - DNA, 50 bp, Homo sapiens
tggcaagttggaaaatatgtaactggaatctcaaaagttctttgggacaa

SEQ ID NO: 2179 - DNA, 50 bp, Homo sapiens
tctgcttatggcacaatttgcctcaaatccattccaagttgtatatttgt

SEQ ID NO: 2180 - DNA, 50 bp, Homo sapiens
ccattgttgtcaaatgcccagtgtccatcagatgtgttcctccattttct

SEQ ID NO: 2181 - DNA, 50 bp, Homo sapiens
gctgcctctgtaaattcatgtattcaaaggaaaagacaccttgcctataa

SEQ ID NO: 2182 - DNA, 50 bp, Homo sapiens
tcaagtcagcaacagagcaaaataaaggttagataagtccttgtgtagca

SEQ ID NO: 2183 - DNA, 50 bp, Homo sapiens; identical to SEQ ID NO: 1719

SEQ ID NO: 2184 - DNA, 50 bp, Homo sapiens
tggttttgaatgcaattaggttatgctatttggacaataaactcaccttg

SEQ ID NO: 2185 - DNA, 50 bp, Homo sapiens
tgcaaggtttaggctggtggcccaggaccatcatcctactgtaataaaga

SEQ ID NO: 2186 - DNA, 50 bp, Homo sapiens
gtgtggtcggggtgagaacccaagcgttggaactgtagacccgtcctgtc

SEQ ID NO: 2187 - DNA, 50 bp, Homo sapiens
agcagcagtgacataaaattccatgttagataagcatatgttacttacct

SEQ ID NO: 2188 - DNA, 50 bp, Homo sapiens
ctccacaataaggtcaatgccagagacggaagcctttttccccaaagtct

SEQ ID NO: 2189 - DNA, 50 bp, Homo sapiens
tggaggtattcaatatcctttgcctcaaggacttcggcagatactgtctc

SEQ ID NO: 2190 - DNA, 50 bp, Homo sapiens
ggtgcccaccattcttggcctgttacttacctgagatgagctcttttaac

SEQ ID NO: 2191 - DNA, 50 bp, Homo sapiens
ttaagaagaaatacccactaacaaagaacaagcattagttttggctgtca

SEQ ID NO: 2192 - DNA, 50 bp, Homo sapiens; identical to SEQ ID NO: 248

SEQ ID NO: 2193 - DNA, 50 bp, Homo sapiens
gggcggcccggagccagccaggcagttttattgaaatctttttaaataat

SEQ ID NO: 2194 - DNA, 50 bp, Homo sapiens; identical to SEQ ID NO: 235

SEQ ID NO: 2195 - DNA, 50 bp, Homo sapiens
agagaacactggacaacattttactactgagggaaatagccaaaaaggca

SEQ ID NO: 2196 - DNA, 50 bp, Homo sapiens
catgggggcaacagccaaaataggggggtaatgatgtaggggccaagcag

SEQ ID NO: 2197 - DNA, 50 bp, Homo sapiens
ttctggaagatggtcagctatgaagtaatagagtttgcttaatcatttgt

SEQ ID NO: 2198 - DNA, 50 bp, Homo sapiens
gggtggctctgatatagtagctctggtgtagtttctgcatttcaagaaga

SEQ ID NO: 2199 - DNA, 50 bp, Homo sapiens
ttccagtcagtttttctcttaagtgcctgtttgagtttactgaaacagtt

SEQ ID NO: 2200 - DNA, 50 bp, Homo sapiens
aaggaccaaggagatgaagcaaacacattaagccttccacactcacctct

SEQ ID NO: 2201 - DNA, 50 bp, Homo sapiens
aggtgcagcctctggaagtggatcaaactagaactcatatgccatactag

SEQ ID NO: 2202 - DNA, 50 bp, Homo sapiens
acttaaaagtttagggttttctcttggttgtagagtggcccagaattgca

SEQ ID NO: 2203 - DNA, 50 bp, Homo sapiens
gtcttgtgactagtgctgaagcttattaatgctaagggcaggcccaaatt

SEQ ID NO: 2204 - DNA, 50 bp, Homo sapiens
ccagagctgctattagaagctgcttcctgtgaagatcaatcttcctgagt

SEQ ID NO: 2205 - DNA, 50 bp, Homo sapiens
tcctctttctcccagcttcaaatgcacaattcatcattgggctcacttct

SEQ ID NO: 2206 - DNA, 50 bp, Homo sapiens
cagcttcaccctgtcaagttaacaaggaatgcctgtgccaataaaaggtt

SEQ ID NO: 2207 - DNA, 50 bp, Homo sapiens
ctcgaatcattgaagatccgagtgtgatttgaattctgtgatattttcac

SEQ ID NO: 2208 - DNA, 50 bp, Homo sapiens
cttcatctggaagaagaggcaagggggcaggagaccaggctctagctctg

SEQ ID NO: 2209 - DNA, 50 bp, Homo sapiens
agactttgccattgttgccattgttttcttttgtacctgaagcattttga

SEQ ID NO: 2210 - DNA, 50 bp, Homo sapiens
aaaagtaggggaggggctgggtctgcaaattaataaatagaagagggggt

SEQ ID NO: 2211 - DNA, 50 bp, Homo sapiens; identical to SEQ ID NO: 467

SEQ ID NO: 2212 - DNA, 50 bp, Homo sapiens
tcagtaaacaaattctttcacaaggtacaaaatcttgcataagctgaact

SEQ ID NO: 2213 - DNA, 50 bp, Homo sapiens
gttttacttaggacaagttgtaccttgccctctctccagctctgctccca

SEQ ID NO: 2214 - DNA, 50 bp, Homo sapiens; identical to SEQ ID NO: 306

SEQ ID NO: 2215 - DNA, 50 bp, Homo sapiens
tggatgtggctgctttcaacaagatctaaaatccatcctggatcatggca

SEQ ID NO: 2216 - DNA, 50 bp, Homo sapiens
tgtggtgtatatccttccaaaaaattaaaacgaaaataaagtagctgcga

SEQ ID NO: 2217 - DNA, 50 bp, Homo sapiens
gtcttccatgtgaacagcataagtttggagcactagtttgattattatgt

SEQ ID NO: 2218 - DNA, 50 bp, Homo sapiens
gcccacacccacactctccagcatctggcacaataaacattctctgtttt

SEQ ID NO: 2219 - DNA, 50 bp, Homo sapiens
agctgtttcctgggtaaatctagagtggggttttggttctttattttccc

SEQ ID NO: 2220 - DNA, 50 bp, Homo sapiens
gcaggagacattggtattctgggcagcttcctaatatgctttacaatctg

SEQ ID NO: 2221 - DNA, 50 bp, Homo sapiens
tggttttcatatcaaaagatcatgttgggattaacttgcctttttcccca

SEQ ID NO: 2222 - DNA, 50 bp, Homo sapiens
atctacaagcggagaaagtgacctagagattgcaagggcggggagaggag

SEQ ID NO: 2223 - DNA, 50 bp, Homo sapiens
tgtttaaatggcttggtgtctttcttttctaattatgcagaataagctct

SEQ ID NO: 2224 - DNA, 50 bp, Homo sapiens
aaaactgtactttgattcacatgttttcaaatggagttggagttcattca

SEQ ID NO: 2225 - DNA, 50 bp, Homo sapiens
tccatcagagctggtctgcacactcacattatcttgctatcactgtaacc

SEQ ID NO: 2226 - DNA, 50 bp, Homo sapiens
gacactttcgagctcccagctccagcttcgtctcaccttgagttaggctg

SEQ ID NO: 2227 - DNA, 50 bp, Homo sapiens; identical to SEQ ID NO: 115

SEQ ID NO: 2228 - DNA, 50 bp, Homo sapiens
aggagtcttttacccggtgtgctttgccgcagtcatccaaaataaattca

SEQ ID NO: 2229 - DNA, 50 bp, Homo sapiens
tagggagccgcaccttgtcatgtaccatcaataaagtaccctgtgctcaa

SEQ ID NO: 2230 - DNA, 50 bp, Homo sapiens
gctgtatataaacgtgtcccgagcttagattctgtatgcggtgacggcgg

SEQ ID NO: 2231 - DNA, 50 bp, Homo sapiens
tgtcttatgtgtcaaaagtcctaggaaagtggttgatgtttcttatagca

SEQ ID NO: 2232 - DNA, 50 bp, Homo sapiens
gctgaatgacatattttatcttgttctttaaaatcacaacacagagctgc

SEQ ID NO: 2233 - DNA, 50 bp, Homo sapiens
tgtctctctctctttttcttttctatggagcaaaacaaagctgatttccc

SEQ ID NO: 2234 - DNA, 50 bp, Homo sapiens
cagtgtactgcaaggaagctggatgcaagatagatactatattaaactgt

SEQ ID NO: 2235 - DNA, 50 bp, Homo sapiens
tgtattgtatgcaaatctgtgattgttggcagtgtcatctctgagaaaca

SEQ ID NO: 2236 - DNA, 50 bp, Homo sapiens
ggggtgtttgtgtgtgtgcgcgtgtgcgtttcaataaagtttgtacactt

SEQ ID NO: 2237 - DNA, 50 bp, Homo sapiens
tttagtatttttcccccaggccagatcattcgtgagtgtgcgagtgtgtg

SEQ ID NO: 2238 - DNA, 50 bp, Homo sapiens
tgctttgtttaaaggactgcagaccaaggagtcgagctttctctcagagc

SEQ ID NO: 2239 - DNA, 50 bp, Homo sapiens
accttatttccactctggtggataagttcaataaaggtcatatcccaaac

SEQ ID NO: 2240 - DNA, 50 bp, Homo sapiens
aatgttgtctgtcttctgtgctgttcctgtaagtttgctattaaaataca

SEQ ID NO: 2241 - DNA, 50 bp, Homo sapiens
accttcctcatttcacagataaggaatctttggggattaaccaacctcct

SEQ ID NO: 2242 - DNA, 50 bp, Homo sapiens
agatacctccccaccaccaattgccaaaggtccaataaaatgcctcaacc

SEQ ID NO: 2243 - DNA, 50 bp, Homo sapiens
gcaatccacaatctgacattctcaggaagcccccaagttgatatttctat

SEQ ID NO: 2244 - DNA, 50 bp, Homo sapiens
tctcaggctgcgtgcagcaacagtgcccagggctctgatgagtctctcat

SEQ ID NO: 2245 - DNA, 50 bp, Homo sapiens
gcctccaaccatgttcccttcttcttagcaccacaaataatcaaaaccca

SEQ ID NO: 2246 - DNA, 50 bp, Homo sapiens
ctcatcttcaacttttgtgctcccctttgcctaaaccctatggcctcctg

SEQ ID NO: 2247 - DNA, 50 bp, Homo sapiens; identical to SEQ ID NO: 818

SEQ ID NO: 2248 - DNA, 50 bp, Homo sapiens
tgtgtgtatggtagcacagcaaacttgtaggaattagtatcaatagtaaa

SEQ ID NO: 2249 - DNA, 50 bp, Homo sapiens
cctgcctggctctctcttcctaccctccttccacatgtacataaactgtc

SEQ ID NO: 2250 - DNA, 50 bp, Homo sapiens
agatgggaatgaagcttgtgtatccattatcatgtgtaatcaataaacga

SEQ ID NO: 2251 - DNA, 50 bp, Homo sapiens
ttaagatttttctcaaagttttgaaaagctattagccaggatcatggtgt

SEQ ID NO: 2252 - DNA, 50 bp, Homo sapiens; identical to SEQ ID NO: 647

SEQ ID NO: 2253 - DNA, 50 bp, Homo sapiens
ccattttgcctttctgacatttccttgggaatctgcaagaacctcccctt

SEQ ID NO: 2254 - DNA, 50 bp, Homo sapiens
ttccgtttggtagactccttccaatgaaatctcaggaataattaaactct

SEQ ID NO: 2255 - DNA, 50 bp, Homo sapiens
ggcagagaaggaggagtatgagcatcagaagagggagctggagcaaatct

SEQ ID NO: 2256 - DNA, 50 bp, Homo sapiens
agcagcctttctgtggagagtgagaataattgtgtacaaagtagagaagt

SEQ ID NO: 2257 - DNA, 50 bp, Homo sapiens
aatgataactaatgacatccagtgtctccaaaattgtttccttgtactga

SEQ ID NO: 2258 - DNA, 50 bp, Homo sapiens
tccctctgggactggacaattgcttcaagcattcttcaaccagcagatgc

SEQ ID NO: 2259 - DNA, 50 bp, Homo sapiens
cggctacatgcctcagtgaaggactagtagttcctgctacaacttcagca

SEQ ID NO: 2260 - DNA, 50 bp, Homo sapiens
catgagtcaagagcatcctgcttctaccatgtggatttggtcacaaggtt

SEQ ID NO: 2261 - DNA, 50 bp, Homo sapiens
gtcagaggtcctgtctggatggaggctggaggctcccccctcaacccctc

SEQ ID NO: 2262 - DNA, 50 bp, Homo sapiens
cctgatacacaattatgaccagaaaatatggctccatgaaggtgctactt

SEQ ID NO: 2263 - DNA, 50 bp, Homo sapiens
attcaattccagagtagtttcaagtttcacatcgtaaccattttcgcccg

SEQ ID NO: 2264 - DNA, 50 bp, Homo sapiens
tggaaatgtcatctaaccattaagtcatgtgtgaacacataaggacgtgt

SEQ ID NO: 2265 - DNA, 50 bp, Homo sapiens
aattcccagatttgaagacaaaaatactctaattctaaccagagcaagct

SEQ ID NO: 2266 - DNA, 50 bp, Homo sapiens
tggcagctacccccttcttgagagtccaagaacctggagcagaaataatt

SEQ ID NO: 2267 - DNA, 50 bp, Homo sapiens; identical to SEQ ID NO: 1730

SEQ ID NO: 2268 - DNA, 50 bp, Homo sapiens
tgccaagcacagtgcctgcatgtatttatccaataaatgtgaaattctgt

SEQ ID NO: 2269 - DNA, 50 bp, Homo sapiens
accactgtatgtttacttctcaccatttgagttgcccatcttgtttcaca

SEQ ID NO: 2270 - DNA, 50 bp, Homo sapiens
ggctgagggttctgctgtcctgtgccaccccattaaagtgcagttcctcc

SEQ ID NO: 2271 - DNA, 50 bp, Homo sapiens; identical to SEQ ID NO: 1840

SEQ ID NO: 2272 - DNA, 50 bp, Homo sapiens
agtctctaaagagtttattttaagacgtgtttgtgtttgtgtgtgtttgt

SEQ ID NO: 2273 - DNA, 50 bp, Homo sapiens
tggaagactaaagaggtgcaatgtgatctgagcctccatcattgtcctcc

SEQ ID NO: 2274 - DNA, 50 bp, Homo sapiens
gcagccagcagatctcagcagcccagtccaaataaacgtcctgtctagca

SEQ ID NO: 2275 - DNA, 50 bp, Homo sapiens
ggtaggagcaaccactgactggtcttaagctgttcttgcataggctctta

SEQ ID NO: 2276 - DNA, 50 bp, Homo sapiens
tcagctacactttgtttttaagtttgtttttgacatgtttatttggcaaa

SEQ ID NO: 2277 - DNA, 50 bp, Homo sapiens
tcccccctccgcctcccaggaagaaagaatgttactgccttaataaaaaa

SEQ ID NO: 2278 - DNA, 50 bp, Homo sapiens
gtgaatttgggctcacagaatcaaagcctatgcttggtagctcttgaaca

SEQ ID NO: 2279 - DNA, 50 bp, Homo sapiens
tccttcctttccactgaaaagcacatggccttgggtgacaaattcctctt

SEQ ID NO: 2280 - DNA, 50 bp, Homo sapiens
agaaatgttcagtaatgaaaaaatatatccaatcagagccatcccgaaaa

SEQ ID NO: 2281 - DNA, 50 bp, Homo sapiens
ttttaacttttaaggttgaaaagacaatagcccaaagccaagaaagaaaa

SEQ ID NO: 2282 - DNA, 50 bp, Homo sapiens
gcactcctttgtcatatactctgcatcactgtcatactcacaacttcgtg

SEQ ID NO: 2283 - DNA, 50 bp, Homo sapiens
tggcagtgggaaaaatgtaggagactgtttggaaattgattttgaacctg

SEQ ID NO: 2284 - DNA, 50 bp, Homo sapiens
catgcaaataaaaagaatgggacctaaactcgtgccgctcgtgccgaatt

SEQ ID NO: 2285 - DNA, 50 bp, Homo sapiens
ggattgcccatccatctgcttacaattccctgctgtcgtcttagcaagaa

SEQ ID NO: 2286 - DNA, 50 bp, Homo sapiens
gagcactggattgctttcccattatgagcgtccttcatctgggcagaccc

SEQ ID NO: 2287 - DNA, 50 bp, Homo sapiens; identical to SEQ ID NO: 1765

SEQ ID NO: 2288 - DNA, 50 bp, Homo sapiens; identical to SEQ ID NO: 1772

SEQ ID NO: 2289 - DNA, 50 bp, Homo sapiens; identical to SEQ ID NO: 1572

SEQ ID NO: 2290 - DNA, 50 bp, Homo sapiens
gacatgcgggctgggcagctgttagagtccaacgtggggcagcacagaga

SEQ ID NO: 2291 - DNA, 50 bp, Homo sapiens
accaaaattcagtgaaggcattctacaagttttgagttagcattacattt

SEQ ID NO: 2292 - DNA, 50 bp, Homo sapiens
taacactgcatcggatgcggggcgtggaggcaccgctgtattaaaggaag

SEQ ID NO: 2293 - DNA, 50 bp, Homo sapiens
tccatcgagcacgtctgaaacccctggtagccccgacttctttttaatta

SEQ ID NO: 2294 - DNA, 50 bp, Homo sapiens
cagtcactggtgtcaccctggataggcaagggataactcttctaacacaa

SEQ ID NO: 2295 - DNA, 50 bp, Homo sapiens
gggaagcactcgtgtgcaacagacaagtgactgtatctgtgtagactatt

SEQ ID NO: 2296 - DNA, 50 bp, Homo sapiens
tctatgagctttgtcagtgcgcgtagatgtcaataaatgttacatacaca

SEQ ID NO: 2297 - DNA, 50 bp, Homo sapiens
atatggtgctgttttctacccttggaaagaaatgtagatgatatgtttcg

SEQ ID NO: 2298 - DNA, 50 bp, Homo sapiens
ttgctaggcgagatagggggaagacagatatgggtgtttttaataaatct

SEQ ID NO: 2299 - DNA, 50 bp, Homo sapiens
aagttgcttcctaacatccttggactgagaaattatacttacttctggca

SEQ ID NO: 2300 - DNA, 50 bp, Homo sapiens
ctcaggcaaagaaaatgaaatgcatatttgcaaagtgtattaggaagtgt

SEQ ID NO: 2301 - DNA, 50 bp, Homo sapiens
tggaagagaggaataaataattcacctatatgtgtttgaggttgtgacag

SEQ ID NO: 2302 - DNA, 50 bp, Homo sapiens
gcctgagcaaagggcctgcccagacaagattttttaattgtttaaaaacc

SEQ ID NO: 2303 - DNA, 50 bp, Homo sapiens
aaatgacacatctgtgcaatagaatgatgtctgctctagggaaaccttca

SEQ ID NO: 2304 - DNA, 50 bp, Homo sapiens
atatttttatttgtttcagttcagataattggcaactgggtgaatctggc

SEQ ID NO: 2305 - DNA, 50 bp, Homo sapiens
ttcccaggaccgaacaagttccagaaaagactgaagaataatcacaattc

SEQ ID NO: 2306 - DNA, 50 bp, Homo sapiens
ttccttatctccctcagacgcagagtttttagtttctctagaaattttgt

SEQ ID NO: 2307 - DNA, 50 bp, Homo sapiens
ttttggaggggtttatgctcaatccatgttctatttcagtgccaataaaa

SEQ ID NO: 2308 - DNA, 50 bp, Homo sapiens
cattgagtggcgcagagccgggtttcatctggaattaactggatggaagg

SEQ ID NO: 2309 - DNA, 50 bp, Homo sapiens
tggaaattcccgtgttgcttcaaactgagacagatgggacttaacaggca

SEQ ID NO: 2310 - DNA, 50 bp, Homo sapiens; identical to SEQ ID NO: 2309

SEQ ID NO: 2311 - DNA, 50 bp, Homo sapiens
cgtcctgcggagccctgtctcctctctctgtaataaactcatttctagcc

SEQ ID NO: 2312 - DNA, 50 bp, Homo sapiens
tttccctgattatgatgagcttccattgttctgttaagtcttgaagagga

SEQ ID NO: 2313 - DNA, 50 bp, Homo sapiens
caaatgcaacctcacaaccttggctgagtcttgagactgaaagatttagc

SEQ ID NO: 2314 - DNA, 50 bp, Homo sapiens; identical to SEQ ID NO: 1862

SEQ ID NO: 2315 - DNA, 50 bp, Homo sapiens
tctgtcatgcccacaatccctttctaaggaagactgccctactatagcag

SEQ ID NO: 2316 - DNA, 50 bp, Homo sapiens
ggagaaataggaatttgtgaacccctaaaattgtagcaactttgaaaggt

SEQ ID NO: 2317 - DNA, 50 bp, Homo sapiens
acaagagtatccacaaaataggttggcactgactatatctctgcttgact

SEQ ID NO: 2318 - DNA, 50 bp, Homo sapiens
gccctcctgaaacttacacacaaaacgttaagtgatgaacattaaatagc

SEQ ID NO: 2319 - DNA, 50 bp, Homo sapiens
aaaccatctactatatgttagacatgacattctttttctctccttcctga

SEQ ID NO: 2320 - DNA, 50 bp, Homo sapiens
gtgtatctcgtggaatcagtggttagcattgccgctattatatttactca

SEQ ID NO: 2321 - DNA, 50 bp, Homo sapiens
ttgtgatgttaagaaatttgtatggtgtggcagtggtctattcctaagga

SEQ ID NO: 2322 - DNA, 50 bp, Homo sapiens
cggatgactgaccaagaggctattcaagatctctggcagtggaggaagtc

SEQ ID NO: 2323 - DNA, 50 bp, Homo sapiens
cctaaatctgtgtgtgtattgtgaagtggtataagaaatgactttgaacc

SEQ ID NO: 2324 - DNA, 50 bp, Homo sapiens
caggctgaggtggaccaagaaggcaaccaagtccccagaggagacccgcg

SEQ ID NO: 2325 - DNA, 50 bp, Homo sapiens
gaatgtagggaagaggtgccaagccaaccgtggggttagctctaattatt

SEQ ID NO: 2326 - DNA, 50 bp, Homo sapiens
acggggatgtcagggaggcaagtgtgttgtgttactgtgtcaataaactg

SEQ ID NO: 2327 - DNA, 50 bp, Homo sapiens
ggcagaatgggccaaaagcttagtgttgtgacctgtttttaaaataaagt

SEQ ID NO: 2328 - DNA, 50 bp, Homo sapiens
caagatggggtgggggatattgagggagacagcgctaaggatggttttat

SEQ ID NO: 2329 - DNA, 50 bp, Homo sapiens
taggcttctatttcctttccacccactcttcacaggctattctactttaa

SEQ ID NO: 2330 - DNA, 50 bp, Homo sapiens
ggtaaccaggtccaatcagtaaaaataagctgcttataactggaaatggc

SEQ ID NO: 2331 - DNA, 50 bp, Homo sapiens
tctgttttaagtaacagaattgataactgagcaaggaaacgtaatttgga

SEQ ID NO: 2332 - DNA, 50 bp, Homo sapiens
tgcctttaattgttctcataatgaagaataagtaggtaccctccatgccc

SEQ ID NO: 2333 - DNA, 50 bp, Homo sapiens
tgccattaagcaggaatgtcatgttccagttcattacaaaagaaaacaat

SEQ ID NO: 2334 - DNA, 50 bp, Homo sapiens
acctgttttgtatacctgagagcctgctatgttcttcttttgttgatcca

SEQ ID NO: 2335 - DNA, 50 bp, Homo sapiens
ctgcttccttcagtttgtaaagtcggtgattatatttttgggggctttcc

SEQ ID NO: 2336 - DNA, 50 bp, Homo sapiens
agcatacttcttttttccagtttcaatctaactgtgaaagaaacttctga

SEQ ID NO: 2337 - DNA, 50 bp, Homo sapiens
gaactctaacacttctctcctccactctgagccccctgaccttccaaacc

SEQ ID NO: 2338 - DNA, 50 bp, Homo sapiens
ccagtgcgtgctgtctgtggagtgtgtctcatgctttcagatgtgcatat

SEQ ID NO: 2339 - DNA, 50 bp, Homo sapiens
ccctgccacatgggtccagtgttcatctgagcataactgtactaaatcct

SEQ ID NO: 2340 - DNA, 50 bp, Homo sapiens
tgcttaaggcaagagtttcagatttactgttgaaataaacccaactgttc

SEQ ID NO: 2341 - DNA, 50 bp, Homo sapiens
cctgacccctcccatccttcccatttcctttgatgttattttgttacagc

SEQ ID NO: 2342 - DNA, 50 bp, Homo sapiens
taagtccctgctgcccttccccttcccacactgtccattcttcctcccat

SEQ ID NO: 2343 - DNA, 50 bp, Homo sapiens
tgatgtgattgtagctttttaaactatgaaacccctgagagattgtacct

SEQ ID NO: 2344 - DNA, 50 bp, Homo sapiens
cccaaaggttcctaagcctggctgcaaagaagaatcaacagggacacttt

SEQ ID NO: 2345 - DNA, 50 bp, Homo sapiens
tagaagtttgctttttccctgcctgtcttggtcactaccacctcttccct

SEQ ID NO: 2346 - DNA, 50 bp, Homo sapiens
tgaccagcactgtctcagtttcactttcacatagatgtccctttcttggc

SEQ ID NO: 2347 - DNA, 50 bp, Homo sapiens
ctgcccatctcagcctcaccatcaccctgctaatgactgccagactgtgg

SEQ ID NO: 2348 - DNA, 50 bp, Homo sapiens
ttcctgaagctgttcccactcccagatggttttatcaatagcctagaggt

SEQ ID NO: 2349 - DNA, 50 bp, Homo sapiens
ggattacctttccttgtaaagaggatgctgccttaagaattgcatgttgt

SEQ ID NO: 2350 - DNA, 50 bp, Homo sapiens
gggtctttggtgtttttaaatgattgtttcttcttcatgcttttgcttgc

SEQ ID NO: 2351 - DNA, 50 bp, Homo sapiens
catggggcgggggcgggaccagggagaattaataaagttctggacttttg

SEQ ID NO: 2352 - DNA, 50 bp, Homo sapiens
atttaaagcacagtttgtttttctgtcacctatagagtgcaagaatgcac

SEQ ID NO: 2353 - DNA, 50 bp, Homo sapiens
cagcactgtctccagataggaacatgcacaaagcagttaattaggcagcc

SEQ ID NO: 2354 - DNA, 50 bp, Homo sapiens
ctcccctcccattcctctggtccctgccttggtcccttgcctgggaagag

SEQ ID NO: 2355 - DNA, 50 bp, Homo sapiens
aaggttggttaaaagatggcagaaagaagatgaaaataaataagcctggt

SEQ ID NO: 2356 - DNA, 50 bp, Homo sapiens
ctcatcaccggttctgtgcctgtgctctgttgtgttggagggaaggactg

SEQ ID NO: 2357 - DNA, 50 bp, Homo sapiens
tttgcttggcaacacgacttgaaataaataaaactttgtttcttaggaga

SEQ ID NO: 2358 - DNA, 50 bp, Homo sapiens
aaaagaaatctgtttcaacagatgaccgtgtacaataccgtgtggtgaaa

SEQ ID NO: 2359 - DNA, 50 bp, Homo sapiens
gacgccacacaccattttcagatgccgttgcaattaaatcttgccacact

SEQ ID NO: 2360 - DNA, 50 bp, Homo sapiens
atgttttagtaacagttggctgtaatcactcctcgccgtgtctggcactg

SEQ ID NO: 2361 - DNA, 50 bp, Homo sapiens
agttctgcgtttggcatcttcactctttccaaaatgtatctgtacatcag

SEQ ID NO: 2362 - DNA, 50 bp, Homo sapiens
tgtgtttgcagagctagtggatgtgtttgtctacaagtatgattgctgtt

SEQ ID NO: 2363 - DNA, 50 bp, Homo sapiens
aaatctggggaagaggttttatttacattttagggtgggtaagaaagcca

SEQ ID NO: 2364 - DNA, 50 bp, Homo sapiens
cagagcggaggctgggatctagcgagagagatgcagaagatgtgaagaaa

SEQ ID NO: 2365 - DNA, 50 bp, Homo sapiens
cgtttggaggggcggtttctggtagttgtggcttttatgctttcaaagaa

SEQ ID NO: 2366 - DNA, 50 bp, Homo sapiens
ggggtgggagggatggggagtcggttagtcattgatagaactactttgaa

SEQ ID NO: 2367 - DNA, 50 bp, Homo sapiens
tgcagaaacagaaaggttttcttctttttgcttcaaaaacattcttacat

SEQ ID NO: 2368 - DNA, 50 bp, Homo sapiens
agattaactgctggacctcctacctgcattatctcattctggcttccttg

SEQ ID NO: 2369 - DNA, 50 bp, Homo sapiens
ctttgtggttttaaagacaactgtgaaataaaattgtttcaccgcctggt

SEQ ID NO: 2370 - DNA, 50 bp, Homo sapiens
gaactcagctgggttggtgaattaactaatggaagacatgaaattgttcc

SEQ ID NO: 2371 - DNA, 50 bp, Homo sapiens
acgatgatggttacccttcatggacgtcttaatcttccacacacatcccc

SEQ ID NO: 2372 - DNA, 50 bp, Homo sapiens
ttcagttctaataatgtccttaaattttatttccagctcctgttccttgg

SEQ ID NO: 2373 - DNA, 50 bp, Homo sapiens
gcctttccattccatttattcacactgagtgtcctacaataaacttccgt

SEQ ID NO: 2374 - DNA, 50 bp, Homo sapiens
tgcattatccagaactgaagttgccctacttttaactttgaacttggcta

SEQ ID NO: 2375 - DNA, 50 bp, Homo sapiens
gcccagtaagacactcatgtggctagtgtttgccgaatgaaactcaactc

SEQ ID NO: 2376 - DNA, 50 bp, Homo sapiens
taagtcttatgccaaattcagtgctactcctcgttacatgacatacaact

SEQ ID NO: 2377 - DNA, 50 bp, Homo sapiens
aagtgagtggacagcctttgtgtgtatctctccaataaagctctgtgggc

SEQ ID NO: 2378 - DNA, 50 bp, Homo sapiens
tctccaagtctttggttgaagagaagatatatgactgttgagtgtgctct

SEQ ID NO: 2379 - DNA, 50 bp, Homo sapiens
ggggaattgtcgcctcctgctcttttgttactgagtgagataaggttgtt

SEQ ID NO: 2380 - DNA, 50 bp, Homo sapiens; identical to SEQ ID NO: 1624

SEQ ID NO: 2381 - DNA, 50 bp, Homo sapiens
cgggcactgggtggggcagggcacgagttatttaaaacagttacactgca

SEQ ID NO: 2382 - DNA, 50 bp, Homo sapiens
cggacatcttttccgttgcggtttgagaatgttcctataataaacccctc

SEQ ID NO: 2383 - DNA, 50 bp, Homo sapiens
tttggcctgttttgatgtatgtgtgaaacaatgttgtccaacaataaaca

SEQ ID NO: 2384 - DNA, 50 bp, Homo sapiens
agcgagctgctctgctatgtccttaagccaatatttactcatcaggtcat

SEQ ID NO: 2385 - DNA, 50 bp, Homo sapiens
tgtagttggggtagattatgatttaggaagcaaaagtaagaagcagcatt

SEQ ID NO: 2386 - DNA, 50 bp, Homo sapiens
gcgatggacagactcacaacctgaacctaggagtgccccattcttttgta

SEQ ID NO: 2387 - DNA, 50 bp, Homo sapiens
gctcaggagggtacaagctccagaacagtaaccaagtgggaaaataaaga

SEQ ID NO: 2388 - DNA, 50 bp, Homo sapiens
ctggattcatgcagccagctttgcaggttatcagagatcaaagattgtaa

SEQ ID NO: 2389 - DNA, 50 bp, Homo sapiens; identical to SEQ ID NO: 1809

SEQ ID NO: 2390 - DNA, 50 bp, Homo sapiens
ctgtggaaaaatatttaagatagttttgccagaacagtttgtacagacgt

SEQ ID NO: 2391 - DNA, 50 bp, Homo sapiens
actctcaaataattaaaaaggactgtattgttgaacagagggacaattgt

SEQ ID NO: 2392 - DNA, 50 bp, Homo sapiens
aactcatgggaataattgtgagtcagcgtaacatttcaagagtctaaagg

SEQ ID NO: 2393 - DNA, 50 bp, Homo sapiens
tgctcctgttctgtcacttgtcatggtctttcttggtattaaaggccacc

SEQ ID NO: 2394 - DNA, 50 bp, Homo sapiens
ggggttgtaaatatcaactattcaacagtttaggatgcaattacgagtgt

SEQ ID NO: 2395 - DNA, 50 bp, Homo sapiens
aatcttatgtttccaagagaactaaagctggagagacctgacccttctct

SEQ ID NO: 2396 - DNA, 50 bp, Homo sapiens
tgcaccaggtgttggaaaaacacaattatggtaaaataaagtgttctcct

SEQ ID NO: 2397 - DNA, 50 bp, Homo sapiens
aatgggcacacagggaacaggaaatgggaatgagagcaagggttgggttg

SEQ ID NO: 2398 - DNA, 50 bp, Homo sapiens
tcttcttcatctctgttttgctcttaaaaatataaaaaggcaattccccg

SEQ ID NO: 2399 - DNA, 50 bp, Homo sapiens
agatgtaacccaccttgaccataaattggcttttcatagtgctcagatgt

SEQ ID NO: 2400 - DNA, 50 bp, Homo sapiens
ctaggctctgggcacatttcctgttcttgaattctgctcctgaagagggt

SEQ ID NO: 2401 - DNA, 50 bp, Homo sapiens
taccctgcccctctttttcggtttgtttttattctttcatttttacaagg

SEQ ID NO: 2402 - DNA, 50 bp, Homo sapiens
gctgcctaacttatccatctttgaacttctgactacttgttgtatctgct

SEQ ID NO: 2403 - DNA, 50 bp, Homo sapiens
cctttaaaacaataaggcgctttcattttgcactctaacttaagagtttt

SEQ ID NO: 2404 - DNA, 50 bp, Homo sapiens
tcctgcctcctgcggctgttggatttgggaatgaccttggtgagagtctc

SEQ ID NO: 2405 - DNA, 50 bp, Homo sapiens
atactctgagctgtggactgaactggcagacacaacctgtacagattgaa

SEQ ID NO: 2406 - DNA, 50 bp, Homo sapiens
aaggaattatgtggtcagtgcattgttttttaaactggaaatcattttgt

SEQ ID NO: 2407 - DNA, 50 bp, Homo sapiens
tgctcttaaaaccagggagtcagatatatttgtaaggttaaatcattggt

SEQ ID NO: 2408 - DNA, 50 bp, Homo sapiens
gccaaaaatctgtcttgaaggcagctacactttgaagtggtctttgaata

SEQ ID NO: 2409 - DNA, 50 bp, Homo sapiens; identical to SEQ ID NO: 651

SEQ ID NO: 2410 - DNA, 50 bp, Homo sapiens
tgactatctgtaatggatcaattttggatatgactttgggtgggggtaaa

SEQ ID NO: 2411 - DNA, 50 bp, Homo sapiens; identical to SEQ ID NO: 1839

SEQ ID NO: 2412 - DNA, 50 bp, Homo sapiens
ggtagtgcctccaggggcagaggaaaagaagaagtgttactgcattttgt

SEQ ID NO: 2413 - DNA, 50 bp, Homo sapiens
atggtcagattagatgcaagaataaagcagttgtccgagtctaagtttct

SEQ ID NO: 2414 - DNA, 50 bp, Homo sapiens
tggtattctgttctgaagtctaggatatttttcagcctataaagccccct

SEQ ID NO: 2415 - DNA, 50 bp, Homo sapiens
acttacccagatgttgcttttgaaaagttgaaatgtgtaattgttttgga

SEQ ID NO: 2416 - DNA, 50 bp, Homo sapiens
agcggactcaggctccagctgtggctacaacatagggtttttatacaaga

SEQ ID NO: 2417 - DNA, 50 bp, Homo sapiens
ttattgtggcaaatgttgtctgacttactgtttcaacaaaccagaagaca

SEQ ID NO: 2418 - DNA, 50 bp, Homo sapiens
tggacagtagcattagaattgtggaaaaggaacacgcaaagggagaagtg

SEQ ID NO: 2419 - DNA, 50 bp, Homo sapiens
ctggtaaattttgtgcttatcttcaaggctggcttaagtataaaattgtt

SEQ ID NO: 2420 - DNA, 50 bp, Homo sapiens
ccctggctccttcagacacgtgcttgatgctgagcaagttcaataaagat

SEQ ID NO: 2421 - DNA, 50 bp, Homo sapiens
gttaacttccaggagttcctcattctggtgataaagatgggctggcagcc

SEQ ID NO: 2422 - DNA, 50 bp, Homo sapiens
cctgtctcgtggcaacaaggctatgttctgttaggagttaccttaaactg

SEQ ID NO: 2423 - DNA, 50 bp, Homo sapiens
agtcagatctttctccttgaatatctttcgataaacaacaaggtggtgtg

SEQ ID NO: 2424 - DNA, 50 bp, Homo sapiens; identical to SEQ ID NO: 1861

SEQ ID NO: 2425 - DNA, 50 bp, Homo sapiens
ccacgggtgatgcttccaggggttctggcgggagtctcagccgaagagag

SEQ ID NO: 2426 - DNA, 50 bp, Homo sapiens; identical to SEQ ID NO: 150

SEQ ID NO: 2427 - DNA, 50 bp, Homo sapiens
accagactgacaaatgtgtatcggatgcttttgttcagggctgtgatcgg

SEQ ID NO: 2428 - DNA, 50 bp, Homo sapiens; identical to SEQ ID NO: 1685

SEQ ID NO: 2429 - DNA, 50 bp, Homo sapiens
cgaagaagagccacagtgagggagatcccatccccttgtctgaactggag

SEQ ID NO: 2430 - DNA, 50 bp, Homo sapiens
gacctgatacggctccccagtacaccccacctcttccttgtaaatatgat

SEQ ID NO: 2431 - DNA, 50 bp, Homo sapiens
ctcaagcgtcctgggatctccttctccctcctgtcctgtccttgcccctc

SEQ ID NO: 2432 - DNA, 50 bp, Homo sapiens
cctcaagggaggagtgatcttcaccaccaagaagggccagcagttctgtg

SEQ ID NO: 2433 - DNA, 50 bp, Homo sapiens
tcctgtgtgtcatgttggtttttggtacttgtattgtcatttggagaaac

SEQ ID NO: 2434 - DNA, 50 bp, Homo sapiens
tcctgtgatggaaatacaactggtatcttcacttttttaggaattgggaa

SEQ ID NO: 2435 - DNA, 50 bp, Homo sapiens
aatttgcagtaaacttttaattaaatgctcatctggtaactcaacacccc

SEQ ID NO: 2436 - DNA, 50 bp, Homo sapiens
gctgcttttgaggagaaaatatatagctttggacacgaggaagatctaga

SEQ ID NO: 2437 - DNA, 50 bp, Homo sapiens
aaacgcttggagtgcttctgaatatacagaagttccatttaagggcaagt

SEQ ID NO: 2438 - DNA, 50 bp, Homo sapiens
tgcatcgtgtttctacctttagtaccttgccactcttttaaaacgctgct

SEQ ID NO: 2439 - DNA, 50 bp, Homo sapiens; identical to SEQ ID NO: 196

SEQ ID NO: 2440 - DNA, 50 bp, Homo sapiens
agacctttctttgggactgtgtggaccaaggagcttccatctagtgacaa

SEQ ID NO: 2441 - DNA, 50 bp, Homo sapiens
gctcagtaacataactgcttcttggagctttggaatattttatcctgtat

SEQ ID NO: 2442 - DNA, 50 bp, Homo sapiens; identical to SEQ ID NO: 1855

SEQ ID NO: 2443 - DNA, 50 bp, Homo sapiens
cgggccttgcatataaataacggagcatacagtgagcacatctagctgat

SEQ ID NO: 2444 - DNA, 50 bp, Homo sapiens
agagatgcctttgtttgatgagattcaaacttgatgctatgctttaaaat

SEQ ID NO: 2445 - DNA, 50 bp, Homo sapiens
agtcccattcttccttttcaatacctacccccaaatcttctcctaaccct

SEQ ID NO: 2446 - DNA, 50 bp, Homo sapiens
tgtcacactggctatcaaagaataagaaaattattgagtatgagtgtgtt

SEQ ID NO: 2447 - DNA, 50 bp, Homo sapiens
gcaaaacccagaagctaaaaagtcaataaacagaaagaatgattttgaga

SEQ ID NO: 2448 - DNA, 50 bp, Homo sapiens
ttgtgaccaaatgggcctcaaagattcagattgaaacaaacaaaaagctt

SEQ ID NO: 2449 - DNA, 50 bp, Homo sapiens
aaggttctattaaccacttctaagggtacacctccctccaaactactgca

SEQ ID NO: 2450 - DNA, 50 bp, Homo sapiens
gttgtatcacccccgagttagcatatcccaggctcgcagactcaacacag

SEQ ID NO: 2451 - DNA, 50 bp, Homo sapiens
ccacttgagtttgtcctccaagggtaggtgtctcatttgttctggcccct

SEQ ID NO: 2452 - DNA, 50 bp, Homo sapiens
tcctgtctctctcctccttactcttggataaataaacagcctgtgagcac

SEQ ID NO: 2453 - DNA, 50 bp, Homo sapiens
cctgaccctctttgaattaagtggactgtggcatgacattctgcaatact

SEQ ID NO: 2454 - DNA, 50 bp, Homo sapiens
tctaaactttattttcaaaagcttaaggcccaaatacaaacttctctgga

SEQ ID NO: 2455 - DNA, 50 bp, Homo sapiens
catggtgatagcctgaaagagctttcctcactagaaaccaaatggtgtaa

SEQ ID NO: 2456 - DNA, 50 bp, Homo sapiens
ggagaaggattagaaagttatgtggcagataaagaattccatgcacctct

SEQ ID NO: 2457 - DNA, 50 bp, Homo sapiens
acagtttttcttttgaatttagtatttgagatgagttgttgggacatgca

SEQ ID NO: 2458 - DNA, 50 bp, Homo sapiens
gatctagtctgttacaccatttagaactttcctcagccattatcagtcat

SEQ ID NO: 2459 - DNA, 50 bp, Homo sapiens
agcatggtaagttcccttagctatatgaattttggcatgtttcagagaga

SEQ ID NO: 2460 - DNA, 50 bp, Homo sapiens
acatttttattctttctactgagggcattgtctgttttctttgtaaatgc

SEQ ID NO: 2461 - DNA, 50 bp, Homo sapiens
aaaaggaaaaccgaattaggtccacttcaatgtccacctgtgagaaagga

SEQ ID NO: 2462 - DNA, 50 bp, Homo sapiens
cctatccccggatgtgtgagaataatgtgttcataaagcatggatctcgt

SEQ ID NO: 2463 - DNA, 50 bp, Homo sapiens
ccagtgtctattctgggttagagaagtgcttactaaggggttttctaata

SEQ ID NO: 2464 - DNA, 50 bp, Homo sapiens
gggtgatctgcttttatctaaatgcaaataaggatgtgttctctgagacc

SEQ ID NO: 2465 - DNA, 50 bp, Homo sapiens; identical to SEQ ID NO: 1748

SEQ ID NO: 2466 - DNA, 50 bp, Homo sapiens
gagccaatccactccttcctttctatcattcccctgcccacctccttcca

SEQ ID NO: 2467 - DNA, 50 bp, Homo sapiens; identical to SEQ ID NO: 184

SEQ ID NO: 2468 - DNA, 50 bp, Homo sapiens
gctgctgccaccgcttcctgcctgtcatttgaataaacagtgtttctatt

SEQ ID NO: 2469 - DNA, 50 bp, Homo sapiens
tgggactcatccaaaagggacgagaagaaagaagaaggaacctgattcgg

SEQ ID NO: 2470 - DNA, 50 bp, Homo sapiens
tcaagactgcctttatgctggatcatgtgctactggtataaagttctggc

SEQ ID NO: 2471 - DNA, 50 bp, Homo sapiens
gtacacccctcaaccctatgcagcctggagtgggcatcaataaaatgaac

SEQ ID NO: 2472 - DNA, 50 bp, Homo sapiens
ccatgagactgatccctggccactgaaaagctttcctgacaataaaaatg

SEQ ID NO: 2473 - DNA, 50 bp, Homo sapiens
ttgggaagtgaccatttctaggcttatacataatagcaataataaaggct

SEQ ID NO: 2474 - DNA, 50 bp, Homo sapiens
atgtggtaaaacccagaaagcatccatcatgaatgcaagatactttcaat

SEQ ID NO: 2475 - DNA, 50 bp, Homo sapiens
ttcacattgtattcagagttgatggttgtacatataagtgattgctggtt

SEQ ID NO: 2476 - DNA, 50 bp, Homo sapiens
gccactggtttctcagaatccaaagatcacatattctagtgtaacactgc

SEQ ID NO: 2477 - DNA, 50 bp, Homo sapiens
ctgtgctttttgcttgggataatggagtttttctttagaaacagtgccaa

SEQ ID NO: 2478 - DNA, 50 bp, Homo sapiens
tatcagactagtgacaagctcctggtcttgagatgtcttctcgttaagga

SEQ ID NO: 2479 - DNA, 50 bp, Homo sapiens
agggcttgaggtgaatttcattaaatggaataatatgatgccactttgca

SEQ ID NO: 2480 - DNA, 50 bp, Homo sapiens
ttgacctcccatttttactatttgccaatacctttttctaggaatgtgct

SEQ ID NO: 2481 - DNA, 50 bp, Homo sapiens
agcgggaaggattttgggtaaatctgagagctgcgataaagtcctaggtt

SEQ ID NO: 2482 - DNA, 50 bp, Homo sapiens
tgatgtttgatggacctatgaatctatttagggagacacagatggctggg

SEQ ID NO: 2483 - DNA, 50 bp, Homo sapiens
agccctgaggatgaacaacctcagagaagaggtggtttagagcaaggaaa

SEQ ID NO: 2484 - DNA, 50 bp, Homo sapiens; identical to SEQ ID NO: 1844

SEQ ID NO: 2485 - DNA, 50 bp, Homo sapiens; identical to SEQ ID NO: 1453

SEQ ID NO: 2486 - DNA, 50 bp, Homo sapiens
gcgggggtggacagggaggcagcttgtgaatttttgttttactgtttaac

SEQ ID NO: 2487 - DNA, 50 bp, Homo sapiens
aacttcagatacttgtgaacatgccttatatttgtccaacaactgtcaga

SEQ ID NO: 2488 - DNA, 50 bp, Homo sapiens
gaagggttggcctgcctggctggggaggtcagtaaactttgaatagtaag

SEQ ID NO: 2489 - DNA, 50 bp, Homo sapiens
aagatgtacccttcaggtgaacctggtatcagacccacagtacttgctgt

SEQ ID NO: 2490 - DNA, 50 bp, Homo sapiens; identical to SEQ ID NO: 1733

SEQ ID NO: 2491 - DNA, 50 bp, Homo sapiens
agtggaatgttctatccccacaagaaggattatatcttatagacttgtct

SEQ ID NO: 2492 - DNA, 50 bp, Homo sapiens
cccgtggccctggagcctcaataaagtgtccctttcattgactggagcag

SEQ ID NO: 2493 - DNA, 50 bp, Homo sapiens
ttatgcatttatcacttccaaatctaactttgcacaagtaacccatgtaa

SEQ ID NO: 2494 - DNA, 50 bp, Homo sapiens
tccgcactatataattcgcacacattaattagggtttatgtaccatacaa

SEQ ID NO: 2495 - DNA, 50 bp, Homo sapiens
gcttgtgaccattttgtatggcttgtctggaaacttctgtaaatcttatg

SEQ ID NO: 2496 - DNA, 50 bp, Homo sapiens
tgctgatttatgcaaagggctggcattctgatgcttttcaggtttaatcc

SEQ ID NO: 2497 - DNA, 50 bp, Homo sapiens
tgcattctggcagttcttttaggattataggttgcaaattatccaaatat

SEQ ID NO: 2498 - DNA, 50 bp, Homo sapiens
ccgacagcccagcctagcccacttgtcatccataaagcaagctcaacctt

SEQ ID NO: 2499 - DNA, 50 bp, Homo sapiens
tttgctgttagtcgggttagagttggctctacgcgaggtttgttaataaa

SEQ ID NO: 2500 - DNA, 50 bp, Homo sapiens
cagactgctagtgttctgtctaaaaaccagacaaggaaatacccttcttt

SEQ ID NO: 2501 - DNA, 50 bp, Homo sapiens
ttttccagtgaggtaaaataaggcataaatgcaggtaattattcccagct

SEQ ID NO: 2502 - DNA, 50 bp, Homo sapiens
ccggcacttctagtggtctcacctggaggcaagagggagggtacagagcc

SEQ ID NO: 2503 - DNA, 50 bp, Homo sapiens; identical to SEQ ID NO: 1701

SEQ ID NO: 2504 - DNA, 50 bp, Homo sapiens; identical to SEQ ID NO: 1264

SEQ ID NO: 2505 - DNA, 50 bp, Homo sapiens
tttccagcaagtatccaaccaacttggttctgcttcaataaatctttgga

SEQ ID NO: 2506 - DNA, 50 bp, Homo sapiens
atgacttgcatcccagctttccaccaaccaaattcaaacattcactgctt

SEQ ID NO: 2507 - DNA, 50 bp, Homo sapiens
tgtatgagactttttgttgcaaaggacacatttatcatattcattcacac

SEQ ID NO: 2508 - DNA, 50 bp, Homo sapiens
tgatctgtccagtgtcactctgtaccctcaacatatatcccttgtgcgat

SEQ ID NO: 2509 - DNA, 50 bp, Homo sapiens
aattcacccctcccacctctttcttcaattaatggaaaagcgttaaggga

SEQ ID NO: 2510 - DNA, 50 bp, Homo sapiens
ctcagtactttgcagaaaacaccaaacaaaaatgccattttaaaaaaggt

SEQ ID NO: 2511 - DNA, 50 bp, Homo sapiens
agccttcagtcagagctcaaaccttagtcaacaccagagaattcacatga

SEQ ID NO: 2512 - DNA, 50 bp, Homo sapiens
aaccctctaagaatacctgtttaagtcttgagtgttgaaaggaattgttt

SEQ ID NO: 2513 - DNA, 50 bp, Homo sapiens; identical to SEQ ID NO: 652

SEQ ID NO: 2514 - DNA, 50 bp, Homo sapiens
tcaggagtgggttgatttcagcacctacagtgtacagtcttgtattaagt

SEQ ID NO: 2515 - DNA, 50 bp, Homo sapiens
ccttcagttatactttcaatgaccttttgtgcatctgttaaggcaaaaca

SEQ ID NO: 2516 - DNA, 50 bp, Homo sapiens
aagtgaacaaaataagcaactaaatgagacctaataattggccttcgatt

SEQ ID NO: 2517 - DNA, 50 bp, Homo sapiens
cacaaccaaatttgatgcgatctgctcagtaatataatttgccattttta

SEQ ID NO: 2518 - DNA, 50 bp, Homo sapiens
acattgtaatagaaacagatttcccaaattccagcctggcatgaggtaat

SEQ ID NO: 2519 - DNA, 50 bp, Homo sapiens
cagactgaatagatcttaactgtctcctacatgtgtgttttcaaatgtgt

SEQ ID NO: 2520 - DNA, 50 bp, Homo sapiens
gatatcccagcggtggtacttcggagacacctgtctgcatctgactgagc

SEQ ID NO: 2521 - DNA, 50 bp, Homo sapiens
acactttcctctgcctttttctcttatatgtgggttcatggttcagttcg

SEQ ID NO: 2522 - DNA, 50 bp, Homo sapiens
agataatgtcaccagtcctcttccttcacttcttgttgtaattgcagcca

SEQ ID NO: 2523 - DNA, 50 bp, Homo sapiens
ccggcacacagggactaggtctagtgagaacatcaggagcagccagggat

SEQ ID NO: 2524 - DNA, 50 bp, Homo sapiens
catcgggttttgggtgtgtgttttcatagcgtggttactttctataatgc

SEQ ID NO: 2525 - DNA, 50 bp, Homo sapiens
atgtatttctttctgactagacttgtgatatgcgtgtgtttatgtacaga

SEQ ID NO: 2526 - DNA, 50 bp, Homo sapiens
gttctgtatcagttgaatttttgtgctcttttccctgtgtacgtggtggt

SEQ ID NO: 2527 - DNA, 50 bp, Homo sapiens
catttatgagttccatgatatgtggtctaagaaagaccaaacagatttct

SEQ ID NO: 2528 - DNA, 50 bp, Homo sapiens
aaatcggttgggtaccatgctttttctccccttcacgtttgcagttgatg

SEQ ID NO: 2529 - DNA, 50 bp, Homo sapiens
gttcatgttggaaagaatgaaaacaacttcaagttcataggcagccagcc

SEQ ID NO: 2530 - DNA, 50 bp, Homo sapiens
tgtcatttaaagacatcaggttcatctgtttactgagctagaaacatagt

SEQ ID NO: 2531 - DNA, 50 bp, Homo sapiens
atctggtgccaaatgaagatttttaggagtgattactaattatcaagggc

SEQ ID NO: 2532 - DNA, 50 bp, Homo sapiens
ttctgcactgggaggtgtaatacatcacaaagacaaagaaaacgcatact

SEQ ID NO: 2533 - DNA, 50 bp, Homo sapiens
agttgaaggaaaatgttcatgttcatatgtacttgtttgctatgactaca

SEQ ID NO: 2534 - DNA, 50 bp, Homo sapiens
cactggggaagtcaagaatggggcctggggctctcagggagaactgcttc

SEQ ID NO: 2535 - DNA, 50 bp, Homo sapiens
ccctagatacagcagtttatacccacacacctgtctacagtgtcattcaa

SEQ ID NO: 2536 - DNA, 50 bp, Homo sapiens
gaaagtgcttagctctctccctcctgacctctgggcagccagtcatcaaa

SEQ ID NO: 2537 - DNA, 50 bp, Homo sapiens
atcatgtatgcaatactttccccctttttgctttgctaaccaaagagcat

SEQ ID NO: 2538 - DNA, 50 bp, Homo sapiens
ctgctgtctcttcagtctgctccatccatcacccatttacccatctctca

SEQ ID NO: 2539 - DNA, 50 bp, Homo sapiens
tatagaaaatgtacagttgtgtgaatgtgaaataaatgtcctcaactccc

SEQ ID NO: 2540 - DNA, 50 bp, Homo sapiens
ggccgtgttcaaagagcaatattccagtaaatgcagactgctgcaaagct

SEQ ID NO: 2541 - DNA, 50 bp, Homo sapiens; identical to SEQ ID NO: 689

SEQ ID NO: 2542 - DNA, 50 bp, Homo sapiens
gaactgacttcaaaggcagcttctggacaggtggtgggaggggacccttc

SEQ ID NO: 2543 - DNA, 50 bp, Homo sapiens
ggagaggctctgtttccagccagttagttttctctgggagacttctctgt

SEQ ID NO: 2544 - DNA, 50 bp, Homo sapiens
tttctattccatacttctgcccacgttgttttctctcaaaatccattcct

SEQ ID NO: 2545 - DNA, 50 bp, Homo sapiens
cctgtacacagccgagcagcatttccgttgaaggacttgcatccccattg

SEQ ID NO: 2546 - DNA, 50 bp, Homo sapiens
ttgatgcttagtggaatgtgtgtctaacttgctctctgacatttagcaga

SEQ ID NO: 2547 - DNA, 50 bp, Homo sapiens
aagaagttaacatgaactcttgaagtcacaccagggcaactcttggaaga

SEQ ID NO: 2548 - DNA, 50 bp, Homo sapiens
ggtggatctccaaccaggccagagaagattctcacagaaggttttgaact

SEQ ID NO: 2549 - DNA, 50 bp, Homo sapiens; identical to SEQ ID NO: 63

SEQ ID NO: 2550 - DNA, 50 bp, Homo sapiens
ggttcgctctactatggagatcaacagttactgtgactgagtcggcccat

SEQ ID NO: 2551 - DNA, 50 bp, Homo sapiens
gctcacactcagcgtgggaccccgaatgttaagcaatgataataaagtat

SEQ ID NO: 2552 - DNA, 50 bp, Homo sapiens
ctgctcgcccctatcgctccagccaaggcgaagaagcacgaacgaatgtc

SEQ ID NO: 2553 - DNA, 50 bp, Homo sapiens
acctgccaccatgttttgtaatttgaggtcttgatttcaccattgtcggt

SEQ ID NO: 2554 - DNA, 50 bp, Homo sapiens
aacgaaaggaagttctgttggaagcatctgaagaaactggaaagagggtt

SEQ ID NO: 2555 - DNA, 50 bp, Homo sapiens
acatttacctgaatgttgtctgaggactgaactgtggactttactattca

SEQ ID NO: 2556 - DNA, 50 bp, Homo sapiens
aaatccagctgcagaaacagacaccccaatgctatttacatacagctcta

SEQ ID NO: 2557 - DNA, 50 bp, Homo sapiens
ccccgttcctcacttttcccttttcattcccaccccctagactttgattt

SEQ ID NO: 2558 - DNA, 50 bp, Homo sapiens
ttcaggcactaagaggggctggacctggcggcaggaagccaaagagactg

SEQ ID NO: 2559 - DNA, 50 bp, Homo sapiens
cgcaacaatccatctctcaagtagtgtatcacagtagtagcctccaggtt

SEQ ID NO: 2560 - DNA, 50 bp, Homo sapiens
cccaggctagggggctatagaaacatctagaaatagactgaaagaaaatc

SEQ ID NO: 2561 - DNA, 50 bp, Homo sapiens
acctacaaaaaagttactgtggtatctatgagttatcatcttagctgtgt

SEQ ID NO: 2562 - DNA, 50 bp, Homo sapiens
tggtgtttagtggataccacatcggaagtgattttctaaattggatttga

SEQ ID NO: 2563 - DNA, 50 bp, Homo sapiens
tcactatctttctgataacagaattgccaaggcagcgggatctcgtatct

SEQ ID NO: 2564 - DNA, 50 bp, Homo sapiens
gaaaagatggagaaaatgaacaggacatggggctcctggaaagaaagggc

SEQ ID NO: 2565 - DNA, 50 bp, Homo sapiens
gtggttttaggatgtcattctttgcagttcttcatcatgagacaagtctt

SEQ ID NO: 2566 - DNA, 50 bp, Homo sapiens
aagggtgaggatgagaagtggtcacgggatttattcagccttggtcagag

SEQ ID NO: 2567 - DNA, 50 bp, Homo sapiens
gagaagattcaggacctcttggtggactctggaaagttcatctacttaga

SEQ ID NO: 2568 - DNA, 50 bp, Homo sapiens
agtacaactggaagccaaaacaaggtggaagatgtcctgaattaagacgt

SEQ ID NO: 2569 - DNA, 50 bp, Homo sapiens
gttgctggcctaatgagcaatgttctcaattttcgttttcattttgctgt

SEQ ID NO: 2570 - DNA, 50 bp, Homo sapiens
acagacctccagaggggacttatggaaaagctgacacctaagtttaccaa

SEQ ID NO: 2571 - DNA, 50 bp, Homo sapiens; identical to SEQ ID NO: 1736

SEQ ID NO: 2572 - DNA, 50 bp, Homo sapiens
tggctttatgtccattttaccactgtttttatccaataaactaagtcggt

SEQ ID NO: 2573 - DNA, 50 bp, Homo sapiens; identical to SEQ ID NO: 688

SEQ ID NO: 2574 - DNA, 50 bp, Homo sapiens
cctttaaggttggaactttgaagttggagaaggtggaataaagttacacc

SEQ ID NO: 2575 - DNA, 50 bp, Homo sapiens
tgccttcgggttgtgctttagtctgtaaaattctaaaggagagctgctaa

SEQ ID NO: 2576 - DNA, 50 bp, Homo sapiens
gcaaaaacctgggaccagcccccttctcccacaaataaagcccaataaag

SEQ ID NO: 2577 - DNA, 50 bp, Homo sapiens
gtcatcggctttcagagggagaccacgggaatgttcagggaaacaatgtc

SEQ ID NO: 2578 - DNA, 50 bp, Homo sapiens
tgaattgcctgttcagggttccttatgcagagaaataaagcagattcagg

SEQ ID NO: 2579 - DNA, 50 bp, Homo sapiens
accaaccacctttccagccatagagattttaattagcccaactagaagcc

SEQ ID NO: 2580 - DNA, 50 bp, Homo sapiens
ctactttgtatgatgaccctgtcctccctcacccaggctgcagtgccatg

SEQ ID NO: 2581 - DNA, 50 bp, Homo sapiens
aaagaggagtggtttgtgacaagcggaatccaaatggcattcgagtggct

SEQ ID NO: 2582 - DNA, 50 bp, Homo sapiens
gaagagccatctcaacagaatcgcaccaaactatactttcaggatgaatt

SEQ ID NO: 2583 - DNA, 50 bp, Homo sapiens
tctgggttgtagagaactctttgtaagcaataaagtttggggtgatgaca

SEQ ID NO: 2584 - DNA, 50 bp, Homo sapiens
ctgctgtccactttccttcaggctctgtgaatacttcaacctgctgtgat

SEQ ID NO: 2585 - DNA, 50 bp, Homo sapiens
gcacctgctccaaaggcatctggcaagaaagcataagtggcaatcataaa

SEQ ID NO: 2586 - DNA, 50 bp, Homo sapiens; identical to SEQ ID NO: 1657

SEQ ID NO: 2587 - DNA, 50 bp, Homo sapiens
agctgccagaaagcacagatttgacccaagctatttatatgttataaagt

SEQ ID NO: 2588 - DNA, 50 bp, Homo sapiens; identical to SEQ ID NO: 1829

SEQ ID NO: 2589 - DNA, 50 bp, Homo sapiens
gatgaggctgacaaagttggggctgagaacacaatcacctattcacttct

SEQ ID NO: 2590 - DNA, 50 bp, Homo sapiens
tcctgcccccgccctgctgtatgatattaatgtggaaggtcatcaataaa

SEQ ID NO: 2591 - DNA, 50 bp, Homo sapiens
aaactgtaaatcataatgtaactgaagcataaacatcacatggcatgttt

SEQ ID NO: 2592 - DNA, 50 bp, Homo sapiens
acaaggacgctggctactgtctattaaaattctgatgtttctgtgaaatt

SEQ ID NO: 2593 - DNA, 50 bp, Homo sapiens
cttccttatggagctggagcagcccgcctagaacccagtctaatgagaac

SEQ ID NO: 2594 - DNA, 50 bp, Homo sapiens
tgcatctcattttgcctaaattggttctgtattcataaacactttccaca

SEQ ID NO: 2595 - DNA, 50 bp, Homo sapiens
agtgaagtctatgatgtgaaacactttgcctcctgtgtactgtgtcataa

SEQ ID NO: 2596 - DNA, 50 bp, Homo sapiens
ttgatgatgtaacttgaccttccagagttatggaaattttgtccccatgt

SEQ ID NO: 2597 - DNA, 50 bp, Homo sapiens
agctcacacgttccacccactgtccctcaaacaatgtcatttcagaaaga

SEQ ID NO: 2598 - DNA, 50 bp, Homo sapiens
ggaccacttttatttattgtcagacacttatttattgggatgtgagcccc

SEQ ID NO: 2599 - DNA, 50 bp, Homo sapiens
gggctgtacccaagctgatttctcatctggtcaataaagctgtttagacc

SEQ ID NO: 2600 - DNA, 50 bp, Homo sapiens
gctctgagggaaacgctgtctgctgccttcatacagatgctgattaaagt

SEQ ID NO: 2601 - DNA, 50 bp, Homo sapiens
ttttagctcaggaaaatatgtcaggctcaaaccacttctcaggcagttta

SEQ ID NO: 2602 - DNA, 50 bp, Homo sapiens
ttgttgaaccataaagtttgcaaagtaaaggttaagtatgaggtcaatgt

SEQ ID NO: 2603 - DNA, 50 bp, Homo sapiens
tgtggtttcagtctctgctagttcatattgcatgtttattttggacagtc

SEQ ID NO: 2604 - DNA, 50 bp, Homo sapiens
agcagaaattttgaagccagaaggacaacatatgaagcttaggagtgaag

SEQ ID NO: 2605 - DNA, 50 bp, Homo sapiens
actgcttcatctccttttgcgcttatttggaaattttagttatagtgttt

SEQ ID NO: 2606 - DNA, 50 bp, Homo sapiens
gagagagtacgggctcagcagccagaggaggccggtgaagtgcatcttct

SEQ ID NO: 2607 - DNA, 50 bp, Homo sapiens
cccagtcaccctcttggagcttccctgctttgaattaaagaccactcatg

SEQ ID NO: 2608 - DNA, 50 bp, Homo sapiens; identical to SEQ ID NO: 2607

SEQ ID NO: 2609 - DNA, 50 bp, Homo sapiens
ggagcgtggcacttacctttgtcccttgcttcattcttgtgagatgataa

SEQ ID NO: 2610 - DNA, 50 bp, Homo sapiens
gcatacacatgcactcagtgtggactgggaagcattactttgtagatgta

SEQ ID NO: 2611 - DNA, 50 bp, Homo sapiens
aagcctcaccattgacttcttccccccatcctcagacattaaagagcctg

SEQ ID NO: 2612 - DNA, 50 bp, Homo sapiens
ctgacctcggcccagcttggactgcacatctggcagctgaggagtcagtg

SEQ ID NO: 2613 - DNA, 50 bp, Homo sapiens
ggaagatcattaaggacggtgagcagcatgaagatctcaatgaagtagcc

SEQ ID NO: 2614 - DNA, 50 bp, Homo sapiens
ttacctctgtcttggctttcatgttattaaacgtatgcatgtgaagaagg

SEQ ID NO: 2615 - DNA, 50 bp, Homo sapiens
agttactggtctctttctgccgaatgttatgttttgcttttatctcacag

SEQ ID NO: 2616 - DNA, 50 bp, Homo sapiens
cacaaagtggcctttggggagaaagtcatgtatttgttcgcaattatgct

SEQ ID NO: 2617 - DNA, 50 bp, Homo sapiens
atttactccaagtcctctccccagctaccaccagtcccttactctgttct

SEQ ID NO: 2618 - DNA, 50 bp, Homo sapiens
gcccatccctgagccaggtaccaccattgtaaggaaacactttcagaaat

SEQ ID NO: 2619 - DNA, 50 bp, Homo sapiens
aggaccgacgcttctggagaaaatacctgcacctgagcttccatgccctg

SEQ ID NO: 2620 - DNA, 50 bp, Homo sapiens
ttcacaaagatttgcgttaatgaagactacacagaaaacctttctaggga

SEQ ID NO: 2621 - DNA, 50 bp, Homo sapiens
atacctgactttagagagagtaaaatgtgccaggagccataggaatatct

SEQ ID NO: 2622 - DNA, 50 bp, Homo sapiens; identical to SEQ ID NO: 679

SEQ ID NO: 2623 - DNA, 50 bp, Homo sapiens
acatccagaaagaaggacacttgtatgctagtctatggtcagttgaggaa

SEQ ID NO: 2624 - DNA, 50 bp, Homo sapiens
ttgactagtaaaagttactgcctagtctttttaccttaggcttacagaat

SEQ ID NO: 2625 - DNA, 50 bp, Homo sapiens
ttgcccaggccagttagaaaatcccttggggaactgtgatgaatattcca

SEQ ID NO: 2626 - DNA, 50 bp, Homo sapiens
ataatcacagttgtgttcctgacactcaataaacagtcactggaaagagt

SEQ ID NO: 2627 - DNA, 50 bp, Homo sapiens
tgaccggattccctcactgttgtatcttgaataaacgctgctgcttcatc

SEQ ID NO: 2628 - DNA, 50 bp, Homo sapiens
ccaaagttggagcttctattgccatgaaccatgcttacaaagaaagcact

SEQ ID NO: 2629 - DNA, 50 bp, Homo sapiens
gtgaactcctgcactggcatttggatgtgtgttaatgctatttgttttgt

SEQ ID NO: 2630 - DNA, 50 bp, Homo sapiens
gctgggtggaaactgctttgcactatcgtttgcttggtgtttgtttttaa

SEQ ID NO: 2631 - DNA, 50 bp, Homo sapiens
gcttgttatcagctttcagggccatggttcacattagaataaaaggtagt

SEQ ID NO: 2632 - DNA, 50 bp, Homo sapiens
ctttgccttgcagccacatggccccatcccagttggggaagccaggtgag

SEQ ID NO: 2633 - DNA, 50 bp, Homo sapiens
tgcgggttattgatttgttctttacaactattgttctcatatttctcaca

SEQ ID NO: 2634 - DNA, 50 bp, Homo sapiens
agttattagttctgctttagctttccaatatgctgtatagcctttgtcat

SEQ ID NO: 2635 - DNA, 50 bp, Homo sapiens
gctgttttcaacattgtatttggactatgcatgtgttttttccccattgt

SEQ ID NO: 2636 - DNA, 50 bp, Homo sapiens
aagtaaatgtacagtgatttgaaatacaataatgaaggcaatgcatggcc

SEQ ID NO: 2637 - DNA, 50 bp, Homo sapiens; identical to SEQ ID NO: 1636

SEQ ID NO: 2638 - DNA, 50 bp, Homo sapiens
tcttaagcaggtttgttttcagcactgatggaaaataccagtgttgggtt

SEQ ID NO: 2639 - DNA, 50 bp, Homo sapiens
ggggttggaaacttagcactttatatttatacagaacattcaggatttgt

SEQ ID NO: 2640 - DNA, 50 bp, Homo sapiens
acccgtgtgaatgtgaagaaaagcagtatgttactggttgttgttgttgt

SEQ ID NO: 2641 - DNA, 50 bp, Homo sapiens
ttgcactgtgagcaaatgctaatacagtaaatatattgtgtttgctgaca

SEQ ID NO: 2642 - DNA, 50 bp, Homo sapiens
aaatgaagtcacacaggacaattattcttatgcctaagttaacagtggat

SEQ ID NO: 2643 - DNA, 50 bp, Homo sapiens
gtcgctgcatatgtgactgtcatgagatcctacttagtatgatcctggct

SEQ ID NO: 2644 - DNA, 50 bp, Homo sapiens
aaggacaaaagttgttgccttcctaagaaccttctttaataaactcattt

SEQ ID NO: 2645 - DNA, 50 bp, Homo sapiens
ctgcattttgattctgaaaagaaagctggctttgcccatttcttattaaa

SEQ ID NO: 2646 - DNA, 50 bp, Homo sapiens
acctgtctgcataataaagctgatcatgttttgctacagtttgcaggtga

SEQ ID NO: 2647 - DNA, 50 bp, Homo sapiens
tactggtagatgtgctcattctccctgaaacatacccatcatattgtcct

SEQ ID NO: 2648 - DNA, 50 bp, Homo sapiens
aggaagcaatgtggttggacctggttaagggaaaggctgattacggaaat

SEQ ID NO: 2649 - DNA, 50 bp, Homo sapiens
aactaatactttgctgttgaaatgttgtgaaatgttaagtgtctggaaat

SEQ ID NO: 2650 - DNA, 50 bp, Homo sapiens
gagctttgtcacttgccacatggtgtcttccaacatgggagggatcagcc

SEQ ID NO: 2651 - DNA, 50 bp, Homo sapiens
ccctgttcactctacttagcatgtccctaccgagtctcttctccactgga

SEQ ID NO: 2652 - DNA, 50 bp, Homo sapiens
tgcacattgtttttcttctgacttccagaaataaaagtgtttccatggga

SEQ ID NO: 2653 - DNA, 50 bp, Homo sapiens
actaaaaaaggagaaattataataaattagccgtcttgcgcccctaggcc

SEQ ID NO: 2654 - DNA, 50 bp, Homo sapiens
acgacaaacctccttgtcaaagtgtgtaaaaataaaggattgctccatcc

SEQ ID NO: 2655 - DNA, 50 bp, Homo sapiens
ccactggggaagggaagtttcagtaacatgacactaaaatggcagagacg

SEQ ID NO: 2656 - DNA, 50 bp, Homo sapiens
aaagattggagctgaagacctaaagtgcttgctttttgcccgttgaccag

SEQ ID NO: 2657 - DNA, 50 bp, Homo sapiens
gaagtcagtgggaaacacacagaaatttattttaaaatctttcaggagct

SEQ ID NO: 2658 - DNA, 50 bp, Homo sapiens
agatgtattagaagtcctgactttcaagtgtaatttgctttggaggagga

SEQ ID NO: 2659 - DNA, 50 bp, Homo sapiens
ctgtgcagaagagctgccaggcagtgtcttagatgtgagacggaggccat

SEQ ID NO: 2660 - DNA, 50 bp, Homo sapiens
acatcatggagggtttagtgcttatctaatttgtgcctcactggacttgt

SEQ ID NO: 2661 - DNA, 50 bp, Homo sapiens
ttgcttaccaaaggaggcccaatttcactcaaatgttttgagaactgtgt

SEQ ID NO: 2662 - DNA, 50 bp, Homo sapiens
tcactcctctgtcctatgaagaccgctgccattggtgttgagaataataa

SEQ ID NO: 2663 - DNA, 50 bp, Homo sapiens
gttaagccaggacatccagaattcattgctttaataaagaacccaggccg

SEQ ID NO: 2664 - DNA, 50 bp, Homo sapiens
tcagttttaacaaatgctattaaagtggagaagcacactctggtcttgga

SEQ ID NO: 2665 - DNA, 50 bp, Homo sapiens
ctcactgcctctttgcagtaggggagagagcagagaagtacaggtcatct

SEQ ID NO: 2666 - DNA, 50 bp, Homo sapiens
ttgactttgctcgaggcaccttttttcctgtttctccttttctgttgtcg

SEQ ID NO: 2667 - DNA, 50 bp, Homo sapiens
aaatgggtttcactgtgaatgcgtgacaataagatattcccttgttccta

SEQ ID NO: 2668 - DNA, 50 bp, Homo sapiens
aacgaatttcctgaacctatcaaactggacaagaatgaccgggccaaggc

SEQ ID NO: 2669 - DNA, 50 bp, Homo sapiens
cttcccctggtcccctgtccctggggctgtttgttaaaaaagagtaataa

SEQ ID NO: 2670 - DNA, 50 bp, Homo sapiens
accgtgaaaattggtttcatttaacaaaagatcagatccctccttcagct

SEQ ID NO: 2671 - DNA, 50 bp, Homo sapiens
tttcttgttacacccactgcactctgcaaccagtgttgcctgcctcatgg

SEQ ID NO: 2672 - DNA, 50 bp, Homo sapiens
gggaaaaacaagaatttcatgactctacctgtggtctatctttaatttca

SEQ ID NO: 2673 - DNA, 50 bp, Homo sapiens
gctgtgcccttgaagagaatagtaatgatgggaatttagaggtttatgac

SEQ ID NO: 2674 - DNA, 50 bp, Homo sapiens
tccaaggaaatggtaacctgtttctgagaacacctgaaatcaatggctat

SEQ ID NO: 2675 - DNA, 50 bp, Homo sapiens
ttcattgtaatccactgttttggctttcatgaacaagtaaattacagtgt

SEQ ID NO: 2676 - DNA, 50 bp, Homo sapiens
acttatttccatgtttctgaatcttctttgtttcaaatggtgctgcatgt

SEQ ID NO: 2677 - DNA, 50 bp, Homo sapiens
atgcccggcctgggatgctgtttggagacggaataaatgttttctcattc

SEQ ID NO: 2678 - DNA, 50 bp, Homo sapiens
tactctaaacctgttatttctgtgctaataaacgagatgcagaacccttg

SEQ ID NO: 2679 - DNA, 50 bp, Homo sapiens
tgcagagagatactaagcagcaaaatcttggtgttgtgatgtacagaaat

SEQ ID NO: 2680 - DNA, 50 bp, Homo sapiens
agtctttgatcttgaaccgatacttttggatctcattgttgatatacctg

SEQ ID NO: 2681 - DNA, 50 bp, Homo sapiens
tggaatcaaataaaatgcttccactaccaaaagacattagagaaaacctt

SEQ ID NO: 2682 - DNA, 50 bp, Homo sapiens
tgccgaataccttaaagtaactaattatccttacacacaaaaggctcagt

SEQ ID NO: 2683 - DNA, 50 bp, Homo sapiens
ctttcccaggatcaaggccacagggaggaagattgcacgggcactgttct

SEQ ID NO: 2684 - DNA, 50 bp, Homo sapiens
cttgtaaactagcgccaaggaactgcagcaaataaactccaactctgccc

SEQ ID NO: 2685 - DNA, 50 bp, Homo sapiens; identical to SEQ ID NO: 1846

SEQ ID NO: 2686 - DNA, 50 bp, Homo sapiens
aggagggtttaaatagggttcagagatcataggaatattaggagttacct

SEQ ID NO: 2687 - DNA, 50 bp, Homo sapiens
tggtggaagtaaaaactggtaactcactcaagtgaatgaatggtcttgca

SEQ ID NO: 2688 - DNA, 50 bp, Homo sapiens
gcaggaaagggaaacagacgcgacagcaacaagagcaccagaagtatatg

SEQ ID NO: 2689 - DNA, 50 bp, Homo sapiens
tccattctgtttcggattttaagtttgagagacttgctaatgaatctcct

SEQ ID NO: 2690 - DNA, 50 bp, Homo sapiens
ccttcagaaacaccgtaattctaaataaacctcttcccatacacctttcc

SEQ ID NO: 2691 - DNA, 50 bp, Homo sapiens
ctggacaactttgagtactgacatcattgataaataaactggcttgtggt

SEQ ID NO: 2692 - DNA, 50 bp, Homo sapiens
cccaggggattttttaagtagatggggggacacggtgaactggctgtgtc

SEQ ID NO: 2693 - DNA, 50 bp, Homo sapiens
actccaaaataaatcaaggctgcaatgcagctggtgctgttcagattcca

SEQ ID NO: 2694 - DNA, 50 bp, Homo sapiens
tgaaatcttaagtgtcttatatgtaatcctgtaggttggtacttccccca

SEQ ID NO: 2695 - DNA, 50 bp, Homo sapiens
tgggagtcttctcttttagacaggggctttttgtttttaaccccaattgt

SEQ ID NO: 2696 - DNA, 50 bp, Homo sapiens
tgacccagatatggaaacagaagacaaaattgtaagccagagtcaacaaa

SEQ ID NO: 2697 - DNA, 50 bp, Homo sapiens
aggtttcatcaggtggttaaagtcgtcaaagttgtaagtgactaaccaag

SEQ ID NO: 2698 - DNA, 50 bp, Homo sapiens
atgctgtcaaagttacagtttacgcaggacattcttgccgtattctcatg

SEQ ID NO: 2699 - DNA, 50 bp, Homo sapiens
tgtgtgtttactaacccttccctgaggcttgtgtatgttggatattgtgg

SEQ ID NO: 2700 - DNA, 50 bp, Homo sapiens
tctgtaatcaaatgattggtgtcattttcccatttgccaatgtagtctca

SEQ ID NO: 2701 - DNA, 50 bp, Homo sapiens
tgcccagcagccatcttaatacattaaaccagtttaaaaaataccttcca

SEQ ID NO: 2702 - DNA, 50 bp, Homo sapiens
gccagagttgccaacccccggctggataccttcagcagagaaatcttccg

SEQ ID NO: 2703 - DNA, 50 bp, Homo sapiens
aatccattaacacctgctcacatcttactcaaaattgtagagttcatagt

SEQ ID NO: 2704 - DNA, 50 bp, Homo sapiens
atttgcaatttggaatttgtgtgagttgatttagtaaaatgttaaaccgc

SEQ ID NO: 2705 - DNA, 50 bp, Homo sapiens
aagtaaagcctcaggaatgcccacgcctttcttccaaagcctttgtctct

SEQ ID NO: 2706 - DNA, 50 bp, Homo sapiens
tcaaacaaatgactttcatattgcaacaatctttgtaagaaccactcaaa

SEQ ID NO: 2707 - DNA, 50 bp, Homo sapiens
ggggaatgtgttccttcattgtatttgggccttttgtattgcactcttga

SEQ ID NO: 2708 - DNA, 50 bp, Homo sapiens
ttgtttacctttcgtgcggtggattctttttaactccgtctacctggcgt

SEQ ID NO: 2709 - DNA, 50 bp, Homo sapiens
ggggtttgtgctatacactgggatgtctaattgcagcaataaagcctttc

SEQ ID NO: 2710 - DNA, 50 bp, Homo sapiens; identical to SEQ ID NO: 1614

SEQ ID NO: 2711 - DNA, 50 bp, Homo sapiens
agcctgcttctgccacacctcgctctcagtctctccacatttccatagag

SEQ ID NO: 2712 - DNA, 50 bp, Homo sapiens
aagtttctcagctcccatttctactctcccatggcttcatgcttctttca

SEQ ID NO: 2713 - DNA, 50 bp, Homo sapiens
gagctactgtgctcatctaaagtgtttgccccacttcccaccccgtctcc

SEQ ID NO: 2714 - DNA, 50 bp, Homo sapiens
atgttaagatttgtgtacaaattgaaatgtctgtactgatcctcaaccaa

SEQ ID NO: 2715 - DNA, 50 bp, Homo sapiens
tctgttgatagctggagaactttagtttcaagtactacattgtgaaagca

SEQ ID NO: 2716 - DNA, 50 bp, Homo sapiens
tgaggggtttcagaattttgcattgcagtcatagaagagatttatttcct

SEQ ID NO: 2717 - DNA, 50 bp, Homo sapiens
ccttgggagggagacttcatgtggtttattgcgagttttttgtttacttt

SEQ ID NO: 2718 - DNA, 50 bp, Homo sapiens
gtatgttaatgccagtcaccagcaggctatttcaaggtcagaagtaatga

SEQ ID NO: 2719 - DNA, 50 bp, Homo sapiens
gcccctaaaggcaagaagaaaaagtaaaagaccttggctcatagaaagtc

SEQ ID NO: 2720 - DNA, 50 bp, Homo sapiens
agtgaaatatgttacagaacatgcacttgccctaataaaaaatcagtgaa

SEQ ID NO: 2721 - DNA, 50 bp, Homo sapiens
tgcagatgctcttaaaagcattgataacctttgtgacgaacataaagaga

SEQ ID NO: 2722 - DNA, 50 bp, Homo sapiens
gctagttcatgtgttctccattcttgtgagcatcctaataaatctgttcc

SEQ ID NO: 2723 - DNA, 50 bp, Homo sapiens
aaccctcccaatatccctagcagcagcagcaaaccaaagtcaaagtatcc

SEQ ID NO: 2724 - DNA, 50 bp, Homo sapiens
cacctccccctacccatatccctcccgtgtgtggttggaaaacttttgtt

SEQ ID NO: 2725 - DNA, 50 bp, Homo sapiens
gagtcctgagccactgccaacatttcccttcttccagttgcactattctg

SEQ ID NO: 2726 - DNA, 50 bp, Homo sapiens
ccccaccccagaacagaaccgtgtctctgataaaggttttgaagtgaata

SEQ ID NO: 2727 - DNA, 50 bp, Homo sapiens
cccatttcttgtttttaaaagaccaacaaatctcaagccctataaatggc

SEQ ID NO: 2728 - DNA, 50 bp, Homo sapiens
agtgtagcttctgaaaggtgctttctccatttatttaaaactacccatgc

SEQ ID NO: 2729 - DNA, 50 bp, Homo sapiens
gagtgcccgattcctcttagagaaaatccatagccttcagatcttggtgt

SEQ ID NO: 2730 - DNA, 50 bp, Homo sapiens
actttgacacctactgtgttataaaatatatcatcagatgtgccttgaga

SEQ ID NO: 2731 - DNA, 50 bp, Homo sapiens; identical to SEQ ID NO: 1697

SEQ ID NO: 2732 - DNA, 50 bp, Homo sapiens
tgatattcaactctgagcatcaggttctaaaaaataatacatactggggt

SEQ ID NO: 2733 - DNA, 50 bp, Homo sapiens
gtcatctccccatttggtcccctggactgtctttgttgattctaacttgt

SEQ ID NO: 2734 - DNA, 50 bp, Homo sapiens
gagaataatgatgtaccaataagtggagattcctccttatgatgtatgct

SEQ ID NO: 2735 - DNA, 50 bp, Homo sapiens
acaagacagactccactcaaaatttatatgaacaccactagatacttcct

SEQ ID NO: 2736 - DNA, 50 bp, Homo sapiens
tccataccattgtgtgtggaggatttacagctaagctgtagttgcagagt

SEQ ID NO: 2737 - DNA, 50 bp, Homo sapiens
acacttttgattgttttctagatgtctaccaataaatgcaatttgtgacc

SEQ ID NO: 2738 - DNA, 50 bp, Homo sapiens
actgtacaatttctgaagatggttattaacactgtgctgttaagcatcca

SEQ ID NO: 2739 - DNA, 50 bp, Homo sapiens
tcagtcctttcttagggaaatgacagggcaaagcaatttttctgttggct

SEQ ID NO: 2740 - DNA, 50 bp, Homo sapiens
agtacaaggcccgaagggtagtgatggtgctaaactcaacatggatttgg

SEQ ID NO: 2741 - DNA, 50 bp, Homo sapiens
ccccagtctgcaaaagaagcacaattctattgctttgtcttgcttatagt

SEQ ID NO: 2742 - DNA, 50 bp, Homo sapiens; identical to SEQ ID NO: 256

SEQ ID NO: 2743 - DNA, 50 bp, Homo sapiens; identical to SEQ ID NO: 1718

SEQ ID NO: 2744 - DNA, 50 bp, Homo sapiens
ccttctttcacaggcatcaggaattgtcaaatgatgattatgagttccct

SEQ ID NO: 2745 - DNA, 50 bp, Homo sapiens
catcttcagcatcgtcttcttgcacatgaaggagaaggagaagtccgact

SEQ ID NO: 2746 - DNA, 50 bp, Homo sapiens
gggaatgctgcaaatgccaaacagctttatgatttcattcacacctcttt

SEQ ID NO: 2747 - DNA, 50 bp, Homo sapiens
ttaaaaatggttgtttaagactttaacaatgggaaccccttgtgagcatg

SEQ ID NO: 2748 - DNA, 50 bp, Homo sapiens
gggagaagtttgcagagcacttcccacctctctgaatagtgtgtatgtgt

SEQ ID NO: 2749 - DNA, 50 bp, Homo sapiens
tggttgacccttgtatgtcacagctctgctctatttattattattttgca

SEQ ID NO: 2750 - DNA, 50 bp, Homo sapiens
tgggaaggaaggctctgtcttcaactctttgaccctccatgtgtaccata

SEQ ID NO: 2751 - DNA, 50 bp, Homo sapiens; identical to SEQ ID NO: 1777

SEQ ID NO: 2752 - DNA, 50 bp, Homo sapiens
ctccccgtgctaaggcccacaaaagccaggactctctgtgcgtgaccctc

SEQ ID NO: 2753 - DNA, 50 bp, Homo sapiens
aattcaagaagaaaaacccaagaagaagaagaaggcacaggaggatctct

SEQ ID NO: 2754 - DNA, 50 bp, Homo sapiens
tcccagagctgatgctattgtacttgcacattggagactgaaaggaaaga

SEQ ID NO: 2755 - DNA, 50 bp, Homo sapiens
ggggaagccgaaggttacaaaggcaaagaaggcagctccgaagaaaaagt

SEQ ID NO: 2756 - DNA, 50 bp, Homo sapiens
tccctgaagaaatatctgtgaaccttctttctgttcagtcctaaaattcg

SEQ ID NO: 2757 - DNA, 50 bp, Homo sapiens
cctctccgaccttcatcactattcttaggataatgctggcgggcagagat

SEQ ID NO: 2758 - DNA, 50 bp, Homo sapiens
actgccatcttacgactatttcttctttttaatacacttaactcaggcca

SEQ ID NO: 2759 - DNA, 50 bp, Homo sapiens
agggtgtttcgttccctttaaatgaatcaacactgccaccttctgtacga

SEQ ID NO: 2760 - DNA, 50 bp, Homo sapiens; identical to SEQ ID NO: 130

SEQ ID NO: 2761 - DNA, 50 bp, Homo sapiens
catttcctgagaccaccagagagaggggagaagcctgggattgacagaag

SEQ ID NO: 2762 - DNA, 50 bp, Homo sapiens; identical to SEQ ID NO: 2761

SEQ ID NO: 2763 - DNA, 50 bp, Homo sapiens
gctaagaagcctataagaggaatttcttttccttcattcatagggaaagg

SEQ ID NO: 2764 - DNA, 50 bp, Homo sapiens
actgacagagtgaactacagaaatagcttttcttcctaaaggggattgtt

SEQ ID NO: 2765 - DNA, 50 bp, Homo sapiens
cagacaatggatgtggggtagaagaagaaaactttgaaggcttaatctct

SEQ ID NO: 2766 - DNA, 50 bp, Homo sapiens
aaaagaagaggaaaagtttagccaagagaatcagagaaagatgctgcatt

SEQ ID NO: 2767 - DNA, 50 bp, Homo sapiens
agtgcacatatttcataaccaaattagcagcaccggtcttaatttgatgt

SEQ ID NO: 2768 - DNA, 50 bp, Homo sapiens
tagacctctttttcttaccagtctcctcccctactctgccccctaagctg

SEQ ID NO: 2769 - DNA, 50 bp, Homo sapiens
agcacagtaaaagtaaagactattctgtttctaggctgttgaatcaaagt

SEQ ID NO: 2770 - DNA, 50 bp, Homo sapiens
catgggcacagtggtgacccccttgattcccaccgtacaaccccctccac

SEQ ID NO: 2771 - DNA, 50 bp, Homo sapiens
cgttatccagtgtgaaaatcagtgagtcctccctggcatcctcgtgaaag

SEQ ID NO: 2772 - DNA, 50 bp, Homo sapiens
gctgaagagtatagtaaagacacctcaaaaggcatgggagggtattatgc

SEQ ID NO: 2773 - DNA, 50 bp, Homo sapiens
ttcagactggtttctgttttttggttattaaaatggtttcctattttgct

SEQ ID NO: 2774 - DNA, 50 bp, Homo sapiens
tttatgattaggtgacgagttgacattgagattgtccttttcccctgatc

SEQ ID NO: 2775 - DNA, 50 bp, Homo sapiens
ccccaaccaggtccgtatgcggtaccttttaaaggttcagtttaatttcc

SEQ ID NO: 2776 - DNA, 50 bp, Homo sapiens
tcctgcaaggctggactgtgatcttcaatcatcctgcccatctctggtac

SEQ ID NO: 2777 - DNA, 50 bp, Homo sapiens
ggtcacggctactcatggaagcaggaccagtaagggaccttcgattaaaa

SEQ ID NO: 2778 - DNA, 50 bp, Homo sapiens
ccttctaacctgaactgatgggtttctccagagggaattgcagagtactg

SEQ ID NO: 2779 - DNA, 50 bp, Homo sapiens
atgtgtaggaggaagagttcaggtggaaaaggagggagctactctcaggc

SEQ ID NO: 2780 - DNA, 50 bp, Homo sapiens
aacgattgtctgcccatgtcctgcctgaaataccatgattgtttatggaa

SEQ ID NO: 2781 - DNA, 50 bp, Homo sapiens
ttccttttaggtatattgcgctaagtgaaacttgtcaaataaatcctcct

SEQ ID NO: 2782 - DNA, 50 bp, Homo sapiens
gtcttgactttggcaaatgagccggagccccttgggcaggtcacacaacc

SEQ ID NO: 2783 - DNA, 50 bp, Homo sapiens
gatacagagttgtccttggaggatggagacaggtgcaaggccaagatgtg

SEQ ID NO: 2784 - DNA, 50 bp, Homo sapiens
tcccatgatggaagtctgcgtaaccaataaattgtgcctttctcactcaa

SEQ ID NO: 2785 - DNA, 50 bp, Homo sapiens
tctacatgtcttgggggcgggctcaaattcttcgaaagtggttggattaa

SEQ ID NO: 2786 - DNA, 50 bp, Homo sapiens
acctgttatcctttgtagagcacacagagttaaaagttgaatatagcaat

SEQ ID NO: 2787 - DNA, 50 bp, Homo sapiens
tgagcttctccagcagtgcgggtcctgggctcctgaaggcttattccatc

SEQ ID NO: 2788 - DNA, 50 bp, Homo sapiens
gcatgtcctcatcctttcctgccataaaagctatgacacgagaatcagaa

SEQ ID NO: 2789 - DNA, 50 bp, Homo sapiens
acccctccccatgaacacaagggttttatcctttcctttaaaaacagtgt

SEQ ID NO: 2790 - DNA, 50 bp, Homo sapiens
tgcaaccaactatccaagtgttataccaactaaaacccccaataaacctt

SEQ ID NO: 2791 - DNA, 50 bp, Homo sapiens
atgcccagacaaaaagctaataccagtcactcgataataaagtattcgca

SEQ ID NO: 2792 - DNA, 50 bp, Homo sapiens
tggcactgagaaacatgcaagatacaggaaaaatgaaaatgttacaagct

SEQ ID NO: 2793 - DNA, 50 bp, Homo sapiens
tctcaaaggagtaactgcagcttggtttgaaatttgtactgtttctatca

SEQ ID NO: 2794 - DNA, 50 bp, Homo sapiens
gtcaacctttgtgagaagccgtatccacttcacaggataaaattgtccat

SEQ ID NO: 2795 - DNA, 50 bp, Homo sapiens
atctccacagcccacccatcccctgagcacactaaccacctcatgcaggc

SEQ ID NO: 2796 - DNA, 50 bp, Homo sapiens
tttcctgactcctccttgcaaacaaaatgatagttgacactttatcctga

SEQ ID NO: 2797 - DNA, 50 bp, Homo sapiens
cctgcagtaacccataggaaataaactgtagagttccatattctgcggcc

SEQ ID NO: 2798 - DNA, 50 bp, Homo sapiens
tagaaagggtttttatggaccaatgccccagttgtcagtcagagccgttg

SEQ ID NO: 2799 - DNA, 50 bp, Homo sapiens
tgtgatgacgtgagatcaataagaagaacctagtctagagacaatgatgc

SEQ ID NO: 2800 - DNA, 50 bp, Homo sapiens
gtgcttgctgtctctcccggacacccttaaagactgtctttttagcaaaa

SEQ ID NO: 2801 - DNA, 50 bp, Homo sapiens
aacattgtttttgtatattgggtgtagatttctgacatcaaaacttggac

SEQ ID NO: 2802 - DNA, 50 bp, Homo sapiens
tgtgtaactggattccttgcatggatcttgtatatagttttatttgctga

SEQ ID NO: 2803 - DNA, 50 bp, Homo sapiens
caggacctccaagccactgagcaatgtataaccccaaagggaattcaaaa

SEQ ID NO: 2804 - DNA, 50 bp, Homo sapiens
gatctgacccaccagtttgtacatcacgtcctgcatgtcccacaccattt

SEQ ID NO: 2805 - DNA, 50 bp, Homo sapiens; identical to SEQ ID NO: 1639

SEQ ID NO: 2806 - DNA, 50 bp, Homo sapiens
tgcgtcttgtgaaattgtgtagagtgtttgtgagctttttgttccctcat

SEQ ID NO: 2807 - DNA, 50 bp, Homo sapiens
cttcggcctccctggccctgggttaaaataaaagctttctggtgatcctg

SEQ ID NO: 2808 - DNA, 50 bp, Homo sapiens
tgagcttgtgcttagtatttacattggatgccagttttgtaatcactgac

SEQ ID NO: 2809 - DNA, 50 bp, Homo sapiens
atttgaaattttctgcagcattaaagctggcgcttaataagaataagtaa

SEQ ID NO: 2810 - DNA, 50 bp, Homo sapiens
tcgcattctgtttcttgctttaaaagaagagtaaagacaagagtgttgga

SEQ ID NO: 2811 - DNA, 50 bp, Homo sapiens; identical to SEQ ID NO: 618

SEQ ID NO: 2812 - DNA, 50 bp, Homo sapiens
ctgtcagccaaggtgcctgaaacgatacgtgtgcccactccactgtcaca

SEQ ID NO: 2813 - DNA, 50 bp, Homo sapiens; identical to SEQ ID NO: 1278

SEQ ID NO: 2814 - DNA, 50 bp, Homo sapiens
tcgatcagtgctcagagattgtgaaatgcagtgttagctccctgggattc

SEQ ID NO: 2815 - DNA, 50 bp, Homo sapiens
aggacaaatcttgttgtattaacagcagggtcacttctcattttctttgc

SEQ ID NO: 2816 - DNA, 50 bp, Homo sapiens
agtcgtattctgtcacataatattttgaagaaaacttggctgtcgaaaca

SEQ ID NO: 2817 - DNA, 50 bp, Homo sapiens
aggagggtgggtggaacaggtggactggagtttctcttgagggcaataaa

SEQ ID NO: 2818 - DNA, 50 bp, Homo sapiens; identical to SEQ ID NO: 2817

SEQ ID NO: 2819 - DNA, 50 bp, Homo sapiens
tgcacctcaagattttaaggagataatgtttttagagagaatttctgctt

SEQ ID NO: 2820 - DNA, 50 bp, Homo sapiens
gcttatggtccccagcatttacagtaacttgtgaatgttaagtatcatct

SEQ ID NO: 2821 - DNA, 50 bp, Homo sapiens
cttgttttgtttgtctctccttttcttttgttactgttcttgctgctaga

SEQ ID NO: 2822 - DNA, 50 bp, Homo sapiens; identical to SEQ ID NO: 704

SEQ ID NO: 2823 - DNA, 50 bp, Homo sapiens
tcaagaataaaaatgcctctccagccttaagtatttacatgctcccaggt

SEQ ID NO: 2824 - DNA, 50 bp, Homo sapiens
tctggaaatgtgttataagctaggagaatccctttggacagtctttattt

SEQ ID NO: 2825 - DNA, 50 bp, Homo sapiens
atttcctatcaccatacttttccatgtgaaaacctgagcctatttctagt

SEQ ID NO: 2826 - DNA, 50 bp, Homo sapiens
tggctgttgctttgcttcatgtgtatggctatttgtatttaacaagactt

SEQ ID NO: 2827 - DNA, 50 bp, Homo sapiens
atagccatcctctttgcagtcctgttggttgtgctcatcctcttcctagt

SEQ ID NO: 2828 - DNA, 50 bp, Homo sapiens
agggccagggctggtgtccctaaggttgtacagactcttgtgaatatttg

SEQ ID NO: 2829 - DNA, 50 bp, Homo sapiens
gccgtgacaatttgttctttgatgtgattgtatttccaatttcttgttca

SEQ ID NO: 2830 - DNA, 50 bp, Homo sapiens
tggtatatacaactttcagagcctcttgtatttggaaggctggaagggcc

SEQ ID NO: 2831 - DNA, 50 bp, Homo sapiens
gctactgcagggtgaggaagaaggggaagaagattgatcaaacagaatga

SEQ ID NO: 2832 - DNA, 50 bp, Homo sapiens
tgtttcaagcccttctgtaaaatatgaagaaaagtctcttagcattctgt

SEQ ID NO: 2833 - DNA, 50 bp, Homo sapiens; identical to SEQ ID NO: 490

SEQ ID NO: 2834 - DNA, 50 bp, Homo sapiens
atctttgtgagcaattatgctcccaaatctaagcaagtaataaagaaggg

SEQ ID NO: 2835 - DNA, 50 bp, Homo sapiens
tgtaaagtttgtacaatttgtcctgaagctttgtgtttggctgcacctgc

SEQ ID NO: 2836 - DNA, 50 bp, Homo sapiens
acagtataactcctgaatgctacttaaataaaccaggattcaaactgcaa

SEQ ID NO: 2837 - DNA, 50 bp, Homo sapiens
agaagcagattttcctgtagaaaaactaatttttctgccttttaccaaaa

SEQ ID NO: 2838 - DNA, 50 bp, Homo sapiens
gagcttgctccagattctgatgcatacggctatattggtttatgtagtca

SEQ ID NO: 2839 - DNA, 50 bp, Homo sapiens
atgggtgttatcacctagctgaatgtttttctaaaggagtttatgttcca

SEQ ID NO: 2840 - DNA, 50 bp, Homo sapiens
acgtgcttcttggtacaggtttgtgaatgacagtttatcgtcatgctgtt

SEQ ID NO: 2841 - DNA, 50 bp, Homo sapiens
tgttgttgttggcaagctgcaggtttgtaatgcaaaaggctgattactga

SEQ ID NO: 2842 - DNA, 50 bp, Homo sapiens
tcattgttcgcttctgtaattctgaaaaactttaaactggtagaacttgg

SEQ ID NO: 2843 - DNA, 50 bp, Homo sapiens
ccagtgctgtttggtggtctgccttctttttaatggtattttcttcctca

SEQ ID NO: 2844 - DNA, 50 bp, Homo sapiens
gccccaccattcatcctgtctgaaggtcctgggtttggtgtgaccgcttg

SEQ ID NO: 2845 - DNA, 50 bp, Homo sapiens
ccgacaggtgggcctgggaggaaaatgtttacatttttaaaggcacactg

SEQ ID NO: 2846 - DNA, 50 bp, Homo sapiens
ggggtggacgcctctgccttcacttgaacacaaatgtgcttcctataaaa

SEQ ID NO: 2847 - DNA, 50 bp, Homo sapiens
ggcagcccccagtccctttctgtcccagctcagttttccaaaagacactg

SEQ ID NO: 2848 - DNA, 50 bp, Homo sapiens
ctgttaagcactgttatgctcagtcatacacgcgaaaggtacaatgtctt

SEQ ID NO: 2849 - DNA, 50 bp, Homo sapiens; identical to SEQ ID NO: 198

SEQ ID NO: 2850 - DNA, 50 bp, Homo sapiens
ttcagttttgctttcaattttatgtaccttagttctgagttagacctgca

SEQ ID NO: 2851 - DNA, 50 bp, Homo sapiens
aaggattatgaggaggttggtgtgcattctgttgaaggagagggtgagga

SEQ ID NO: 2852 - DNA, 50 bp, Homo sapiens
tcccttccttctgttgctggtgtactctaggacttcaaagtgtgtctggg

SEQ ID NO: 2853 - DNA, 50 bp, Homo sapiens
agttcattaaaaactgcaaaaccaatctgtatcatgtaccaaactgactt

SEQ ID NO: 2854 - DNA, 50 bp, Homo sapiens
tgcacgttcctcctggttccttcgcttgtgtttctgtacttaccaaaaat

SEQ ID NO: 2855 - DNA, 50 bp, Homo sapiens
tgccagacctccttcctgacctctgaggcaggagaggaataaagacggtc

SEQ ID NO: 2856 - DNA, 50 bp, Homo sapiens
agtcccaagggtgttttgttactgttttctccatgaataaactcacttga

SEQ ID NO: 2857 - DNA, 50 bp, Homo sapiens
attaatgtcatttctggaagtgtgaaaatgttaatgttcaacaagcaaca

SEQ ID NO: 2858 - DNA, 50 bp, Homo sapiens
gcgggtgggccgagcagtgtggacatcagccactttttatattcatgtac

SEQ ID NO: 2859 - DNA, 50 bp, Homo sapiens
ccactgagaactaaatgctgtaccacagagccgggtgtgaactatggttt

SEQ ID NO: 2860 - DNA, 50 bp, Homo sapiens
aaacaatcgctccgggctcagggctgcgcggctcttcccttcattccatg

SEQ ID NO: 2861 - DNA, 50 bp, Homo sapiens
tgtcctctgttcaattcctaacgcaaactacaataaatggtgacacacgt

SEQ ID NO: 2862 - DNA, 50 bp, Homo sapiens
agcacctaaggagcttgaatcttggttcctgtaaaatttcaaattgatgt

SEQ ID NO: 2863 - DNA, 50 bp, Homo sapiens
accaacactgtcccaaggtgaaatgaagcaacagagaggaaattgtacat

SEQ ID NO: 2864 - DNA, 50 bp, Homo sapiens
tgtcagccatttcaatgtcttgggaaacaattttttgtttttgttctgtt

SEQ ID NO: 2865 - DNA, 50 bp, Homo sapiens
agagcttgatcgccagtggaagaagattagtgcaatcattgagaagagga

SEQ ID NO: 2866 - DNA, 50 bp, Homo sapiens
tttccctcttccctgacctcccaactctaaagccaagcactttatatttt

SEQ ID NO: 2867 - DNA, 50 bp, Homo sapiens
ggcaggtgaccattggcacacgctagaagtttatggcagagctttacaaa

SEQ ID NO: 2868 - DNA, 50 bp, Homo sapiens
ctgtttgtagataggttttttatctctcagtacacattgccaaatggagt

SEQ ID NO: 2869 - DNA, 50 bp, Homo sapiens; identical to SEQ ID NO: 84

SEQ ID NO: 2870 - DNA, 50 bp, Homo sapiens
tagactcattgtaagttgccactgccaacatgagaccaaagtgtgtgact

SEQ ID NO: 2871 - DNA, 50 bp, Homo sapiens
caaacctttctggcctgttatgattctgaacatttgacttgaaccacaag

SEQ ID NO: 2872 - DNA, 50 bp, Homo sapiens
gggaaagtatagcatgaaaccagaggttctcagaatgaccgtaagatagc

SEQ ID NO: 2873 - DNA, 50 bp, Homo sapiens; identical to SEQ ID NO: 1594

SEQ ID NO: 2874 - DNA, 50 bp, Homo sapiens; identical to SEQ ID NO: 1643

SEQ ID NO: 2875 - DNA, 50 bp, Homo sapiens
cttctggcacccctggggttcaatactggaagtgccttatttaaccagac

SEQ ID NO: 2876 - DNA, 50 bp, Homo sapiens
ggtctttagcctccaccttgtctaagctttggtctataaagtgcgctaca

SEQ ID NO: 2877 - DNA, 50 bp, Homo sapiens
tgatgatatgacatctggctaaaaagaaattattgcaaaactaaccacga

SEQ ID NO: 2878 - DNA, 50 bp, Homo sapiens
tccaaagcagtctccactgttgttgtgactacagctccgtctcctaaaca

SEQ ID NO: 2879 - DNA, 50 bp, Homo sapiens
attgtcaccaggttggaactcttgcctctgtgaggatgccttctctactg

SEQ ID NO: 2880 - DNA, 50 bp, Homo sapiens
ttttctttgtatatttctagtatggcacatgatatgagtcactgcctttt

SEQ ID NO: 2881 - DNA, 50 bp, Homo sapiens
tgaccttcatgataccagtgagaagccaggctagagaaataaaatcctga

SEQ ID NO: 2882 - DNA, 50 bp, Homo sapiens
acggattggttaaaaaatgcttcatatttgaaaaagctgggaattgctgt

SEQ ID NO: 2883 - DNA, 50 bp, Homo sapiens
gtctctctccattgtgttccgatccatttctgtgtgttcccccaaccttt

SEQ ID NO: 2884 - DNA, 50 bp, Homo sapiens
gccactgccataacttgtttgtaaaagagctgttctttttgactgattgt

SEQ ID NO: 2885 - DNA, 50 bp, Homo sapiens
gaacattgcccagcactacggcatgtcgtacctcctggagaccctggagt

SEQ ID NO: 2886 - DNA, 50 bp, Homo sapiens
atcttcattgggggattgagcagcatttaataaagtctatgtttgtattt

SEQ ID NO: 2887 - DNA, 50 bp, Homo sapiens
ttataaccgagggctggcgttttggaatcgaatttcgacagggattggaa

SEQ ID NO: 2888 - DNA, 50 bp, Homo sapiens; identical to SEQ ID NO: 1820

SEQ ID NO: 2889 - DNA, 50 bp, Homo sapiens; identical to SEQ ID NO: 206

SEQ ID NO: 2890 - DNA, 50 bp, Homo sapiens
aaccaaggagttttccccgtttgtaaaaagacattgtagataattgaatg

SEQ ID NO: 2891 - DNA, 50 bp, Homo sapiens
accatgttctttcgttaaagatttgctttatacaagattgttgcagtacc

SEQ ID NO: 2892 - DNA, 50 bp, Homo sapiens
cacatctgcttccactgtgttcccacgggtgccatgaagtgtgtgaggag

SEQ ID NO: 2893 - DNA, 50 bp, Homo sapiens
cgcactacttcacctgagccacccaacctaaatgtacttatctgtcccca

SEQ ID NO: 2894 - DNA, 50 bp, Homo sapiens; identical to SEQ ID NO: 2193

SEQ ID NO: 2895 - DNA, 50 bp, Homo sapiens
ctctccaagagtattattaacgctgctgtacctcgatctgaatctgccgg

SEQ ID NO: 2896 - DNA, 50 bp, Homo sapiens
tccctaatagaaagccacctattctttgttggatttcttcaagtttttct

SEQ ID NO: 2897 - DNA, 50 bp, Homo sapiens
agtactgcttttgtatgtatgttgaacaggatccaggtttttatagcttg

SEQ ID NO: 2898 - DNA, 50 bp, Homo sapiens
cactttctatcctctgtaaactttttgtgctgaatgttgggactgctaaa

SEQ ID NO: 2899 - DNA, 50 bp, Homo sapiens
gaagaatgggcaaagaagtaatcatgtagttgaagtctgtggatgcagct

SEQ ID NO: 2900 - DNA, 50 bp, Homo sapiens
caaaggttcttgagactcttgatatttctgtcttctccttgtgctttcct

SEQ ID NO: 2901 - DNA, 50 bp, Homo sapiens
ccgatggatctacagttgcaatgagaagcagaagttacttcctcaccagc

SEQ ID NO: 2902 - DNA, 50 bp, Homo sapiens
ttcctgcataactcaatctgaaccaaggattgtagtttagttttcctcct

SEQ ID NO: 2903 - DNA, 50 bp, Homo sapiens
gcagggtggtggtattctgtcatttacacacgtcgttctaattaaaaagc

SEQ ID NO: 2904 - DNA, 50 bp, Homo sapiens
gcactttttgtttgaatgttagatgcttagtgtgaagttgatacgcaagc

SEQ ID NO: 2905 - DNA, 50 bp, Homo sapiens
gcaagaaatattccattgaaatattgtgctgtaacatgggaaagtgtaaa

SEQ ID NO: 2906 - DNA, 50 bp, Homo sapiens
gccaacactgtctgtctcaaatactgtgctgtgagttgtttcaataaagg

SEQ ID NO: 2907 - DNA, 50 bp, Homo sapiens
gacctcatctccaagatggagaagatctgacctccacggagccgctgtcc

SEQ ID NO: 2908 - DNA, 50 bp, Homo sapiens
ctttactaaaaaagaagcacctgagtggtctaagaaacaaaagatgaaga

SEQ ID NO: 2909 - DNA, 50 bp, Homo sapiens
gcctggaagactctgaaggagcgtgagagcatcctgaagctgctggatgg

SEQ ID NO: 2910 - DNA, 50 bp, Homo sapiens
caggaggaagctctggcccttgtattacacattctggacattaaaaataa

SEQ ID NO: 2911 - DNA, 50 bp, Homo sapiens
gccttttgagtctttccgatacctgagtttttatgcttataatttttgtt

SEQ ID NO: 2912 - DNA, 50 bp, Homo sapiens
ttaagctgaggatacaaccaggaaatgcaacggtgtcagattgtgttcaa

SEQ ID NO: 2913 - DNA, 50 bp, Homo sapiens; identical to SEQ ID NO: 1714

SEQ ID NO: 2914 - DNA, 50 bp, Homo sapiens
agcaataaactctggatgtttgtgcgcgtgtgtggacagtcttatcttcc

SEQ ID NO: 2915 - DNA, 50 bp, Homo sapiens
agctgttgatgctggttggacaggtttgagtcaaattgtactttgctcca

SEQ ID NO: 2916 - DNA, 50 bp, Homo sapiens
aggtgacatttcccaccctgtgcccgtgttcccaataaaaacaaattcac

SEQ ID NO: 2917 - DNA, 50 bp, Homo sapiens
ctgtggctgactgtaatactgtacaactgtttctgaccattaaatgctgt

SEQ ID NO: 2918 - DNA, 50 bp, Homo sapiens
acatatgcagacctgacactcaagagtggctagctacacagagtccatct

SEQ ID NO: 2919 - DNA, 50 bp, Homo sapiens
tgacttcacagacatggtctagaatctgtacccttacccacatatgaaga

SEQ ID NO: 2920 - DNA, 50 bp, Homo sapiens
cccagtctctgtcagcactcccttcttcccttttatagttcatcagccac

SEQ ID NO: 2921 - DNA, 50 bp, Homo sapiens
tgactgagtacccctttagtgagtacccctttagtgctatatttgtgcca

SEQ ID NO: 2922 - DNA, 50 bp, Homo sapiens
tgccttttgagcaaatagggaatctaagggaggaaattatcaactgtgca

SEQ ID NO: 2923 - DNA, 50 bp, Homo sapiens
gcggggccggggggactctggtatctaattctttaatgattcctataaat

SEQ ID NO: 2924 - DNA, 50 bp, Homo sapiens
acaactttctgtacaatattgattcccatctggcatattctaatcaggtt

SEQ ID NO: 2925 - DNA, 50 bp, Homo sapiens; identical to SEQ ID NO: 633

SEQ ID NO: 2926 - DNA, 50 bp, Homo sapiens
aacaacattaacttgtggcctctttctacacctggaaatttactcttgaa

SEQ ID NO: 2927 - DNA, 50 bp, Homo sapiens
acagccgagtcctgcatcagccctttatcctcacacgcttttctacaatg

SEQ ID NO: 2928 - DNA, 50 bp, Homo sapiens
gtcaaggctaagtcaaatgaaactgaattttaaactttttgcatgcttct

SEQ ID NO: 2929 - DNA, 50 bp, Homo sapiens
aaacgacatgaaggtagatgaagtcctttacgaagactcgtcaacagctt

SEQ ID NO: 2930 - DNA, 50 bp, Homo sapiens
cccaataccaagaccaactggcatagagccaactgagataaatgctattt

SEQ ID NO: 2931 - DNA, 50 bp, Homo sapiens
gggtctatacagagtcaatatattttttcagagaaagttagttcggctcg

SEQ ID NO: 2932 - DNA, 50 bp, Homo sapiens
ccagaaagtgtgggctgaagatggttggtttcatgtgggggtattatgta

SEQ ID NO: 2933 - DNA, 50 bp, Homo sapiens
tccaaccttgagatccagtgtcaggagttctctattcctcccaactctga

SEQ ID NO: 2934 - DNA, 50 bp, Homo sapiens
tggcacagaaaagggaccaagtttaaaaaagggttttaaatgtaatgaga

SEQ ID NO: 2935 - DNA, 50 bp, Homo sapiens
ggggtaggttggttgttcagagtcttcccaataaagatgagtttttgagc

SEQ ID NO: 2936 - DNA, 50 bp, Homo sapiens
tgggcatagggacccatcattgatgactgatgaaaccatgtaataaagca

SEQ ID NO: 2937 - DNA, 50 bp, Homo sapiens
attttcctacagccctttgtacttcaaaatatgtttttgtgtccatcagt

SEQ ID NO: 2938 - DNA, 50 bp, Homo sapiens
tcagcactaactaaataaatttgttggttcagttgtacttgtcctgcaaa

SEQ ID NO: 2939 - DNA, 50 bp, Homo sapiens
agagggtggatcacacctcagtgggaagaaaaataaaatttccttcaggt

SEQ ID NO: 2940 - DNA, 50 bp, Homo sapiens
tgtgtaagtctgcctaaataggtagcttaaacttatgtcaaaatgtctgc

SEQ ID NO: 2941 - DNA, 50 bp, Homo sapiens
tcctttctgcttagtgaatgaatactggaatccatctgtgttgatacaat

SEQ ID NO: 2942 - DNA, 50 bp, Homo sapiens
gcaataccaagagaaaatgcacaaatatcactggatggagatgtcacatt

SEQ ID NO: 2943 - DNA, 50 bp, Homo sapiens
tggggatctcagggccaggagttatgttttgatttggaattttaattatt

SEQ ID NO: 2944 - DNA, 50 bp, Homo sapiens
ccagtaacttcgctctgttagaggtggaggattttcctatgttcccccca

SEQ ID NO: 2945 - DNA, 50 bp, Homo sapiens
tgctgaaaagattgtactttgtgatcccaatcagagggatggagctaatc

SEQ ID NO: 2946 - DNA, 50 bp, Homo sapiens
tcagactgctgagaaggaagaatttgaacatcaacagaaagagctggaga

SEQ ID NO: 2947 - DNA, 50 bp, Homo sapiens
tgggcagcttgggtaagtacgcaacttacttttccaccaaagaactgtca

SEQ ID NO: 2948 - DNA, 50 bp, Homo sapiens; identical to SEQ ID NO: 1651

SEQ ID NO: 2949 - DNA, 50 bp, Homo sapiens; identical to SEQ ID NO: 1702

SEQ ID NO: 2950 - DNA, 50 bp, Homo sapiens; identical to SEQ ID NO: 629

SEQ ID NO: 2951 - DNA, 50 bp, Homo sapiens
atgggccaggcagagaacagaactggaggcagtccatctagggaatggga

SEQ ID NO: 2952 - DNA, 50 bp, Homo sapiens
gtttcctttttgggtgaaatggatttatgtgagtgctttaaacaaatagc

SEQ ID NO: 2953 - DNA, 50 bp, Homo sapiens
gaacaatggagccagctgaaggaacagatttctgacatagatgacgcagt

SEQ ID NO: 2954 - DNA, 50 bp, Homo sapiens; identical to SEQ ID NO: 1747

SEQ ID NO: 2955 - DNA, 50 bp, Homo sapiens; identical to SEQ ID NO: 1664

SEQ ID NO: 2956 - DNA, 50 bp, Homo sapiens
agcacagatggtgcaatactttccttctttgaagagatcccaaagttagt

SEQ ID NO: 2957 - DNA, 50 bp, Homo sapiens
tggaagaatgtacagcttatggacaaatgtacacctttttgttactttaa

SEQ ID NO: 2958 - DNA, 50 bp, Homo sapiens
ttttggagcaaaaactatgggttgtaatttgaataaagtgtcactaagca

SEQ ID NO: 2959 - DNA, 50 bp, Homo sapiens
ttcagcaggaaaatgattcaatttttaaacaaaatgtaacagatggcagt

SEQ ID NO: 2960 - DNA, 50 bp, Homo sapiens
aagtagccaagctaagatgcctggctgggcttctgaggaattaatacact

SEQ ID NO: 2961 - DNA, 50 bp, Homo sapiens
ctgaccgccactctcacatttgggctcttcgctggccttggtggagctgg

SEQ ID NO: 2962 - DNA, 50 bp, Homo sapiens
tgcattgtgtagctagttttctggaaaagtcaatcttttaggaattgttt

SEQ ID NO: 2963 - DNA, 50 bp, Homo sapiens
acagctatactttgttgtgtaatgttatggttccctttctgtaaaatgtt

SEQ ID NO: 2964 - DNA, 50 bp, Homo sapiens
gacaggatcccccagagaccccatttgcctctcaacactcagaccttcaa

SEQ ID NO: 2965 - DNA, 50 bp, Homo sapiens
tttggtttaaaatgtaagataggaaaatgttggatatttgaggccatgct

SEQ ID NO: 2966 - DNA, 50 bp, Homo sapiens
aatctacattttcttaccaggagcagcattgaggtttttgagcatagtac

SEQ ID NO: 2967 - DNA, 50 bp, Homo sapiens
actaacccacgattctgagccctgagtatgcctggacattgatgctaaca

SEQ ID NO: 2968 - DNA, 50 bp, Homo sapiens
ttattctgcgtccccttctccaataaaacaagccagttgggcgtggttat

SEQ ID NO: 2969 - DNA, 50 bp, Homo sapiens
tccttcccactctctccaacatcacattcactttaaatttttctgtatat

SEQ ID NO: 2970 - DNA, 50 bp, Homo sapiens
agtcccaaaaaagccttgtgaaaatgttatgccctatgtaacagcagagt

SEQ ID NO: 2971 - DNA, 50 bp, Homo sapiens
aggggagggcactacacttccttgagagaaaccgctgtcattaataaaag

SEQ ID NO: 2972 - DNA, 50 bp, Homo sapiens
aggctgtagaaggaaatataccttaacaggctgatttggagtgacccaga

SEQ ID NO: 2973 - DNA, 50 bp, Homo sapiens
accagttacccaaaatctgattagaagtataaggtgctctgaagtgtcct

SEQ ID NO: 2974 - DNA, 50 bp, Homo sapiens
tgaggcttgtgaggccaatcaaaataatgtttgtgatctctactactgtt

SEQ ID NO: 2975 - DNA, 50 bp, Homo sapiens
cagttcccaaggacttgtcatttcatgttcttattttagacctgttttgt

SEQ ID NO: 2976 - DNA, 50 bp, Homo sapiens
accactagaagattccgggaacgttgggagtcacctgattctgcaaagat

SEQ ID NO: 2977 - DNA, 50 bp, Homo sapiens
gtcaagctgaccttgctgatggtgacattgcacctggatgtactatccaa

SEQ ID NO: 2978 - DNA, 50 bp, Homo sapiens
acagctcaagtaccctaatttagttcttttggactaatacaattcaggaa

SEQ ID NO: 2979 - DNA, 50 bp, Homo sapiens
gatgacgctgggcacagagggtcaggtcctgtcaagaggagctgggtgtc

SEQ ID NO: 2980 - DNA, 50 bp, Homo sapiens
aacatctctcttctccttcccaactactgcatgaagaaattctacttcca

SEQ ID NO: 2981 - DNA, 50 bp, Homo sapiens
ttcctgcctggattatttaaaaagccatgtgtggaaacccactatttaat

SEQ ID NO: 2982 - DNA, 50 bp, Homo sapiens
tgctacatttccaaggtgaagatgtgtgggcacatgttatggcagattga

SEQ ID NO: 2983 - DNA, 50 bp, Homo sapiens
acaaccatcaacattgctgttcaaagaaattacagtttacgtccattcca

SEQ ID NO: 2984 - DNA, 50 bp, Homo sapiens
cccacccataggccctgtccatacccatgtaaggtgttcaataaagaaca

SEQ ID NO: 2985 - DNA, 50 bp, Homo sapiens
actcttcaggagcttggcatcatggactgttaatgtatgtgattttcccc

SEQ ID NO: 2986 - DNA, 50 bp, Homo sapiens
ggtcaagggtgtcctccactctttaacagctgctggacagacacattaga

SEQ ID NO: 2987 - DNA, 50 bp, Homo sapiens
gcaacttcatgtcaactttctggctcctcaaacagtaggttggcagtaag

SEQ ID NO: 2988 - DNA, 50 bp, Homo sapiens
ccaagtggagacggggatggggaaaaatactgattctgtggaaaataccc

SEQ ID NO: 2989 - DNA, 50 bp, Homo sapiens; identical to SEQ ID NO: 1684

SEQ ID NO: 2990 - DNA, 50 bp, Homo sapiens
gcaggggctccagcaacaaaaaagaaacagcaacagaaaaagaagaaagg

SEQ ID NO: 2991 - DNA, 50 bp, Homo sapiens
agactcacttaccctcttggaaagctggtacagaaggaagtctgtggctg

SEQ ID NO: 2992 - DNA, 50 bp, Homo sapiens
cctggtcattggtggatgttaaacccatattcctttcaactgctgcctgc

SEQ ID NO: 2993 - DNA, 50 bp, Homo sapiens
aatgaattggcctggctaccactgtggtcgcgtgctacaggtttgacaaa

SEQ ID NO: 2994 - DNA, 50 bp, Homo sapiens
ttgatttgccataagtcttcccttgcttgcatcttccaaagctatttcga

SEQ ID NO: 2995 - DNA, 50 bp, Homo sapiens
agtgaagttacagtggaaatgagtggagggggattgtctttcaacgcagc

SEQ ID NO: 2996 - DNA, 50 bp, Homo sapiens
gcttggtcattatgaaccaggtgagcaatgcctacctataccgcaagagg

SEQ ID NO: 2997 - DNA, 50 bp, Homo sapiens
aaggcactgaaaatataaaaggactggtagtttactgatgtagatgtgaa

SEQ ID NO: 2998 - DNA, 50 bp, Homo sapiens
gcagaaaaggggaactcatttagctcacgagtggtcgagtgaagattgaa

SEQ ID NO: 2999 - DNA, 50 bp, Homo sapiens
tatcttgagacgccttacaaatgatggaggattccaaagagtttttgttt

SEQ ID NO: 3000 - DNA, 50 bp, Homo sapiens
aaaatgttgttgtgtacataccatgctttcaatgttggcttccaagtttt

SEQ ID NO: 3001 - DNA, 50 bp, Homo sapiens
ggtagaatgtgctcttctatatctactcctcaataaagcatgttctctgc

SEQ ID NO: 3002 - DNA, 50 bp, Homo sapiens
ccacaagaggatttaagggaggaatgtttataggacacacacacaaaagc

SEQ ID NO: 3003 - DNA, 50 bp, Homo sapiens
ctccagcagggtcagccattcacacccatccactcacctcccattcccag

SEQ ID NO: 3004 - DNA, 50 bp, Homo sapiens
aaactggcagaatgtccgggccttatatatcaagagcaccatgggcaagc

SEQ ID NO: 3005 - DNA, 50 bp, Homo sapiens; identical to SEQ ID NO: 1797

SEQ ID NO: 3006 - DNA, 50 bp, Homo sapiens
tgggagtgaggatgggaatgctgtatctgtggaagtcatgttatactgga

SEQ ID NO: 3007 - DNA, 50 bp, Homo sapiens
tgcttagatcactgcagcttctaggacccggtttcttttactgatttaaa

SEQ ID NO: 3008 - DNA, 50 bp, Homo sapiens
ctgaactaccaaatagctgtgggctttctggaactgctggctgggttgct

SEQ ID NO: 3009 - DNA, 50 bp, Homo sapiens
gctctgtgactttaagagaagaaggggggaggggtcccggattttatgtt

SEQ ID NO: 3010 - DNA, 50 bp, Homo sapiens
agaaatgtccttctttcactctgcatctttcttttctttgagtcgttttt

SEQ ID NO: 3011 - DNA, 50 bp, Homo sapiens
tccagataaagcaagaatagttgcaagaagtaaattctggcacaaagcgt

SEQ ID NO: 3012 - DNA, 50 bp, Homo sapiens
cccacaatggctttgattatgatttccccctgctgtgtgccgagctgcgg

SEQ ID NO: 3013 - DNA, 50 bp, Homo sapiens
aaattacagaaacatgttaaaggccggacaaaggaaagacaataaaatca

SEQ ID NO: 3014 - DNA, 50 bp, Homo sapiens
gaagtacgcggtcaaggcctgaggggcgcattgtcaataaagcacagctg

SEQ ID NO: 3015 - DNA, 50 bp, Homo sapiens
tctacagccatgtcctattccttgatcatccaaagcacctgcagagtcca

SEQ ID NO: 3016 - DNA, 50 bp, Homo sapiens
aatgtagcttaatcataatctcacactgaagattttgcatcacttttgct

SEQ ID NO: 3017 - DNA, 50 bp, Homo sapiens
tgatgatgatgttcaaagagaaagaaatggagtgattcagcacacaggcg

SEQ ID NO: 3018 - DNA, 50 bp, Homo sapiens
gccaccagccaagcaaccccctaaaacattcatatctaggcagtattttg

SEQ ID NO: 3019 - DNA, 50 bp, Homo sapiens
gcctttaccatgttctctccacatccgtaaataaacttccttcactacaa

SEQ ID NO: 3020 - DNA, 50 bp, Homo sapiens
ccacacctggcgagtaggccaagaaggaaaatctgacgaataaagacccc

SEQ ID NO: 3021 - DNA, 50 bp, Homo sapiens
gggctgagccccgcccagctcccctccacaataaacgctgtttctccttg

SEQ ID NO: 3022 - DNA, 50 bp, Homo sapiens
tttctcagcctacaaattgtgtctatacatttctaagccttgtttgcaga

SEQ ID NO: 3023 - DNA, 50 bp, Homo sapiens
gagcccacccccagcacccccatctgttaataaatatctcaactccaaaa

SEQ ID NO: 3024 - DNA, 50 bp, Homo sapiens
tggagtgatttcacagtgtgtactgttttgccacatacttctaaagaaca

SEQ ID NO: 3025 - DNA, 50 bp, Homo sapiens
ccctttggaaatggtgaaggaaccagcccaatagaagtacagagccagct

SEQ ID NO: 3026 - DNA, 50 bp, Homo sapiens
ctccctcaaggctgggaggagataaacaccaacccaggaattctcaataa

SEQ ID NO: 3027 - DNA, 50 bp, Homo sapiens
agggactgaaattgtggggggaaggtaggaggcacatcaataaagaggaa

SEQ ID NO: 3028 - DNA, 50 bp, Homo sapiens
tggggcaaaaccttgctaattttctcaaaagcatttatcattcttgttgc

SEQ ID NO: 3029 - DNA, 50 bp, Homo sapiens
cccccagtgtgcaagggcagtgaagacttgattgtacaaaatacgttttg

SEQ ID NO: 3030 - DNA, 50 bp, Homo sapiens
agatggcgagaacctaagtttcagttgattttacaattgaaatgactaaa

SEQ ID NO: 3031 - DNA, 50 bp, Homo sapiens
tgtcagaccttcttccacagcaaatgagatgtatgcccaaagcggtagaa

SEQ ID NO: 3032 - DNA, 50 bp, Homo sapiens
gttgcagggcgaggtcaagagagttctgacctggatggcccatagacctg

SEQ ID NO: 3033 - DNA, 50 bp, Homo sapiens
gacagcaggattggatgttgtgtattgtggtttattttattttcttcatt

SEQ ID NO: 3034 - DNA, 50 bp, Homo sapiens
agtgccttccctgcctgtgggggtcatgctgccacttttaatgggtcctc

SEQ ID NO: 3035 - DNA, 50 bp, Homo sapiens
tttggagtttttctgaaaaatggagcagtaatgcagcatcaacctattaa

SEQ ID NO: 3036 - DNA, 50 bp, Homo sapiens
caatggacaagtatttcctaatggtaccagaccactggacaggcttgggt

SEQ ID NO: 3037 - DNA, 50 bp, Homo sapiens
gtgttggagaggggctgtgtctgggtgagggatggcggggtactgatttt

SEQ ID NO: 3038 - DNA, 50 bp, Homo sapiens
gtgctttgagggtcagcctttaggaaggtgcagctttgttgtcctttgag

SEQ ID NO: 3039 - DNA, 50 bp, Homo sapiens
ggctcacatcaaaaggctaataggtgaatttgaccaacagcaagcagagt

SEQ ID NO: 3040 - DNA, 50 bp, Homo sapiens
cagaaagcaaacaacacaattacaaggttgaatctgaggaaaataatcct

SEQ ID NO: 3041 - DNA, 50 bp, Homo sapiens
tctctctgtgttctctgtattgtactaaccaacctcccaaatcgctgagc

SEQ ID NO: 3042 - DNA, 50 bp, Homo sapiens
cctggaataaaactcaacatgcagatttgcctactcatagggactttgcc

SEQ ID NO: 3043 - DNA, 50 bp, Homo sapiens
tgcctccctgatggaaaactatataaaattgtagacttaaaaggtttgtg

SEQ ID NO: 3044 - DNA, 50 bp, Homo sapiens
ttcattgtaaagatgttgatggtctcaataaaatgctaacttgccagtga

SEQ ID NO: 3045 - DNA, 50 bp, Homo sapiens
cgtccgcacggtacgtcttcatgggagtcattttattccttacagcttcc

SEQ ID NO: 3046 - DNA, 50 bp, Homo sapiens
tggtgtttggtttggggtgttttttaagttttttcttttatatcatccag

SEQ ID NO: 3047 - DNA, 50 bp, Homo sapiens
ctccctgctcttggttctcctctagattgaagtttgttttctgatgctgt

SEQ ID NO: 3048 - DNA, 50 bp, Homo sapiens
tgaagacatagttcacctaaaatggcatcctgctctgaatctagactttt

SEQ ID NO: 3049 - DNA, 50 bp, Homo sapiens
ccctttgagatttgtgtttgtgtcctgctttgagctgtaccttgtccagt

SEQ ID NO: 3050 - DNA, 50 bp, Homo sapiens; identical to SEQ ID NO: 477

SEQ ID NO: 3051 - DNA, 50 bp, Homo sapiens
ccagtgacacctctgaaagcccccattccctgagaatcctgttgttagta

SEQ ID NO: 3052 - DNA, 50 bp, Homo sapiens
cctggtcagtggtggtcttcaagacgacagctctgtatctgccatgtgaa

SEQ ID NO: 3053 - DNA, 50 bp, Homo sapiens
cccacttcccatgctggatgggcagaagacattgcttattggagacaaat

SEQ ID NO: 3054 - DNA, 50 bp, Homo sapiens
ttactggcatatgttttgtagactgtttaatgactggatatcttccttca

SEQ ID NO: 3055 - DNA, 50 bp, Homo sapiens
aatgtaaggttgttttgggggatggagttagaaccttaatgataatttct

SEQ ID NO: 3056 - DNA, 50 bp, Homo sapiens
tttggagtgggcaaagtaacctcttgcttggtgcaactatttgtttcaaa

SEQ ID NO: 3057 - DNA, 50 bp, Homo sapiens
gcttataaacacatttgaggaataggaggtccgggttttccataatgggt

SEQ ID NO: 3058 - DNA, 50 bp, Homo sapiens
tcttatcattgcatacattttctggatgcttgagccatcagatatcagct

SEQ ID NO: 3059 - DNA, 50 bp, Homo sapiens; identical to SEQ ID NO: 989

SEQ ID NO: 3060 - DNA, 50 bp, Homo sapiens
tgcattattgtgtagccacggttttctggaaaagttgatattttaggaat

SEQ ID NO: 3061 - DNA, 50 bp, Homo sapiens
attacattggaagggagctttcaagatggtaggatattgactaactgagc

SEQ ID NO: 3062 - DNA, 50 bp, Homo sapiens
catggtacaggcttggagcttgcaggtccctttctactgtggtgttggag

SEQ ID NO: 3063 - DNA, 50 bp, Homo sapiens
tgtgcagggacagttggcttccagaggtttcagctttcagttatttgaga

SEQ ID NO: 3064 - DNA, 50 bp, Homo sapiens
aattccattttattgggaacccattttccacctggtctttcttgacaggg

SEQ ID NO: 3065 - DNA, 50 bp, Homo sapiens
aaataaacttgtgtggtaaaagtacatgccatgtgtccctcaactgaaaa

SEQ ID NO: 3066 - DNA, 50 bp, Homo sapiens
ttcaagacaattttaattgtgaacctaccatgttgcctcccatcttctga

SEQ ID NO: 3067 - DNA, 50 bp, Homo sapiens
tttgtaagagctgggagcaaacacgtttatgagtgtgtcggaatcccgtg

SEQ ID NO: 3068 - DNA, 50 bp, Homo sapiens
cccaaacaggcatgtatcaaaacacctgtggagtactttagactccaaca

SEQ ID NO: 3069 - DNA, 50 bp, Homo sapiens
tggggccaaaagtccagtgaaattgtaagcttcaataaaaggatgaaact

SEQ ID NO: 3070 - DNA, 50 bp, Homo sapiens
tgggctggagtagaggactctggtgggaaggttttgctgctaatgtattt

SEQ ID NO: 3071 - DNA, 50 bp, Homo sapiens
agctaaacagtacttaaatagcggttggaactaggtagcctttcgaattt

SEQ ID NO: 3072 - DNA, 50 bp, Homo sapiens
tgtcattcatttttcagaatataaccactcaagctactggcacatagtga

SEQ ID NO: 3073 - DNA, 50 bp, Homo sapiens
tctgatagagaaaaagactgctttgtcactcaaacatgttccttcgacct

SEQ ID NO: 3074 - DNA, 50 bp, Homo sapiens; identical to SEQ ID NO: 1404

SEQ ID NO: 3075 - DNA, 50 bp, Homo sapiens
tttgatgttaaacagtaaatgccagtagtgaccaagaacacagtgattat

SEQ ID NO: 3076 - DNA, 50 bp, Homo sapiens
cctttgcctttatactttaggggtcttactccattaattcatttgttaca

SEQ ID NO: 3077 - DNA, 50 bp, Homo sapiens
tgcacgttatggtgtttctccctctcactgtctgagagtttagttgtagc

SEQ ID NO: 3078 - DNA, 50 bp, Homo sapiens
ctgtagagagtcttcaagatcccggagtggtagcgctgtctcctggtgaa

SEQ ID NO: 3079 - DNA, 50 bp, Homo sapiens; identical to SEQ ID NO: 960

SEQ ID NO: 3080 - DNA, 50 bp, Homo sapiens
gatccagaatccactctccagtctccctcccctgactccctctgctgtcc

SEQ ID NO: 3081 - DNA, 50 bp, Homo sapiens
attccattctattgtttacacaacgattactcgaagatgactgcaaaggt

SEQ ID NO: 3082 - DNA, 50 bp, Homo sapiens
agccaagaagagagcattaaacccaagaacattgtggagaagattgactt

SEQ ID NO: 3083 - DNA, 50 bp, Homo sapiens
tatattgtacttactgtgacagcagataataaaccagtctcttggagggc

SEQ ID NO: 3084 - DNA, 50 bp, Homo sapiens
cttattctcccattgggcagctgaggaccgaggcacagaggtgcggtgac

SEQ ID NO: 3085 - DNA, 50 bp, Homo sapiens
tcactgtataccactggagttttctggttatctctcgtatagcaaaatct

SEQ ID NO: 3086 - DNA, 50 bp, Homo sapiens
gctgccacctcctgttcatttagaactatgcaaagactccgcttccgttt

SEQ ID NO: 3087 - DNA, 50 bp, Homo sapiens
acagcaaagccccaactaatctttagaagcatattggaactgataactcc

SEQ ID NO: 3088 - DNA, 50 bp, Homo sapiens; identical to SEQ ID NO: 530

SEQ ID NO: 3089 - DNA, 50 bp, Homo sapiens
gtcaacatcatccggcaccctctggggtaggagaacagccattccacatg

SEQ ID NO: 3090 - DNA, 50 bp, Homo sapiens
tcatatgtgtggttatactcataataatgggccttgtaagccttttcacc

SEQ ID NO: 3091 - DNA, 50 bp, Homo sapiens
ctgcttgactcaccggcttcctatttgatgcacccaggcccccttgtggc

SEQ ID NO: 3092 - DNA, 50 bp, Homo sapiens
gggacagaaacacaaacgcaaaaaattcagacaaaagcagtaatgtttaa

SEQ ID NO: 3093 - DNA, 50 bp, Homo sapiens
gcgatcctcatcccttcagcaatatgtatttgagttcacactatttctgt

SEQ ID NO: 3094 - DNA, 50 bp, Homo sapiens
ttttgaacagcgaaaccagcgtttgcgagggagccccaatttcacaccag

SEQ ID NO: 3095 - DNA, 50 bp, Homo sapiens
ttccaaaagaaaaactagttgcagtcagggagccagcgaaaagacaaaaa

SEQ ID NO: 3096 - DNA, 50 bp, Homo sapiens
actgagagtggtgtctggatatattccttttgtcttcatcactttctgaa

SEQ ID NO: 3097 - DNA, 50 bp, Homo sapiens
gcatgcattcattggttgttcaataagtgagatgattacagataatactg

SEQ ID NO: 3098 - DNA, 50 bp, Homo sapiens
ctgatttcataaccaggccggaccacgtgcaatagggtggaaaccaaact

SEQ ID NO: 3099 - DNA, 50 bp, Homo sapiens
gaagacgacgcggattactactgctctgttggctacggctttagtcccta

SEQ ID NO: 3100 - DNA, 50 bp, Homo sapiens
tgaacctcagcccattaggcaggaaaagttgatatttaataaacaaggaa

SEQ ID NO: 3101 - DNA, 50 bp, Homo sapiens
ccaaggcacttggtttttctgttttatatactaataatcagggcctaagt

SEQ ID NO: 3102 - DNA, 50 bp, Homo sapiens
gggggccattcgattcgcctcagttgctgctgtaataaaagtctactttt

SEQ ID NO: 3103 - DNA, 50 bp, Homo sapiens
actttaagaaaaaacaaataattgttgcagaggtctctgtattttgcagc

SEQ ID NO: 3104 - DNA, 50 bp, Homo sapiens
ctgtaccagtgctggctgcaggtattaagtccaagtttattaactagata

SEQ ID NO: 3105 - DNA, 50 bp, Homo sapiens
gccacctctgtgttcctgtcatagcaaatatgggaccatcaccagcttac

SEQ ID NO: 3106 - DNA, 50 bp, Homo sapiens
tcctgaggtgatatacttcatatttgtaatcaactgaaagagctgtgcat

SEQ ID NO: 3107 - DNA, 50 bp, Homo sapiens
tgctgggtttgccatctttttgttttctttgaaaagcagcttagttaccc

SEQ ID NO: 3108 - DNA, 50 bp, Homo sapiens
ccactagttgatgtatggtatctttagatatttgcctgtctgtttgctca

SEQ ID NO: 3109 - DNA, 50 bp, Homo sapiens
aatggcctacaaccaagctatttgtcccctactttgagtcttaactgtgg

SEQ ID NO: 3110 - DNA, 50 bp, Homo sapiens
atcctgagctgcacttacctgtgagagtcttcaaacttttaaaccttgcc

SEQ ID NO: 3111 - DNA, 50 bp, Homo sapiens
tgctctgagatggggaacagaacacacaagtatgaagtttctttcaggtg

SEQ ID NO: 3112 - DNA, 50 bp, Homo sapiens
aagcacacccgtggttgtgaaaatagtatagcaaaaaagaaaaatccccg

SEQ ID NO: 3113 - DNA, 50 bp, Homo sapiens
tgtttacctgcttgcagcatattagaacagacgatccatgctaatattgt

SEQ ID NO: 3114 - DNA, 50 bp, Homo sapiens
aatccttacttaaaattcttccgttaccacccttgaaacaattagctttt

SEQ ID NO: 3115 - DNA, 50 bp, Homo sapiens
ataacagttctatttggaatgatacccacaactctacaagcatcttatcc

SEQ ID NO: 3116 - DNA, 50 bp, Homo sapiens
agagatttgtacatttgtgtaataggccttttcatgctttatgtgtagct

SEQ ID NO: 3117 - DNA, 50 bp, Homo sapiens
tcttggtgtatttcttatgcaaacaatcttcaggcagcaaagatgtctgt

SEQ ID NO: 3118 - DNA, 50 bp, Homo sapiens
aacctgtactgttggtattgtgttagtgtatggaccaatactgcctgtaa

SEQ ID NO: 3119 - DNA, 50 bp, Homo sapiens
aattgagggaccatcagataactgtattttgtcaggtgcaataaaaacaa

SEQ ID NO: 3120 - DNA, 50 bp, Homo sapiens
ctatgtgtactcctcatccctcctgctgtatattttctcattttttgcgt

SEQ ID NO: 3121 - DNA, 50 bp, Homo sapiens
ttaaaagtaacaaaaactgccatttgacagtaaaggctcttggcttctgt

SEQ ID NO: 3122 - DNA, 50 bp, Homo sapiens
gctcccttctctttgatagcagttataatgcccttgttcccaataaaact

SEQ ID NO: 3123 - DNA, 50 bp, Homo sapiens
ctgagatactgctgctggaatgggcgagacattgctgcaaagaagtcaag

SEQ ID NO: 3124 - DNA, 50 bp, Homo sapiens
ctgcggcgtgttaggaatgacctggaattgtcaataaacagatgctgctg

SEQ ID NO: 3125 - DNA, 50 bp, Homo sapiens
agctccctagctgaacgggttaccctggtcattaataaagctgtgactgg

SEQ ID NO: 3126 - DNA, 50 bp, Homo sapiens
ctcatctaaagacaccttcctttccactggctgtcaagccacagggcacc

SEQ ID NO: 3127 - DNA, 50 bp, Homo sapiens
ggcagaatccacaccagcttatcaaccaacacagctaattttagaatagg

SEQ ID NO: 3128 - DNA, 50 bp, Homo sapiens
gacaggacagtgaccttgggaggaaggggctactccgccatccttaaaag

SEQ ID NO: 3129 - DNA, 50 bp, Homo sapiens
ggacaagttggaacagaagaccaagagtggcctcactggatacatcaagg

SEQ ID NO: 3130 - DNA, 50 bp, Homo sapiens
ccccaattctgtggcgcatccagattgtgaaaatgtacaataaatgtgta

SEQ ID NO: 3131 - DNA, 50 bp, Homo sapiens
ttcagagaactttttgcatgcttatggttgatcagttaaaaaagaatgtt

SEQ ID NO: 3132 - DNA, 50 bp, Homo sapiens
tgctgtttctgtagccatattgtattctgtgtcaaataaagtccagttgg

SEQ ID NO: 3133 - DNA, 50 bp, Homo sapiens
acgccacccaaacctttcactttccaaagagctagccgtcctccacccag

SEQ ID NO: 3134 - DNA, 50 bp, Homo sapiens
gcatctgagatcctgttggaaaccacagcaacctgtattcattattagga

SEQ ID NO: 3135 - DNA, 50 bp, Homo sapiens
ggacgtgacctgtgctgagggctgtgagaatgtgaaacaacagtgtgaaa

SEQ ID NO: 3136 - DNA, 50 bp, Homo sapiens
gccatcagattgatcttcttcacaccaagctctgtttacattccgagagg

SEQ ID NO: 3137 - DNA, 50 bp, Homo sapiens
cctttcctcacagggaccaagacaaagcatgggacatgaaattaagagtg

SEQ ID NO: 3138 - DNA, 50 bp, Homo sapiens
aagcatgattcccacaaggactaagtatcagtgatttgtaattttcctgt

SEQ ID NO: 3139 - DNA, 50 bp, Homo sapiens
acctgttggttttaatgtgcatgtgaatggcctagagaacctatttttgt

SEQ ID NO: 3140 - DNA, 50 bp, Homo sapiens
ccgaccaagatccctccctgcaagacagatgggaatgtgtataataacta

SEQ ID NO: 3141 - DNA, 50 bp, Homo sapiens; identical to SEQ ID NO: 890

SEQ ID NO: 3142 - DNA, 50 bp, Homo sapiens
ggacggtgtccccgcacgtttgtattgtgtataaatacattcattaataa

SEQ ID NO: 3143 - DNA, 50 bp, Homo sapiens
atcctttcctcaacctcctcctttcccaattaatttcaaccatagtacga

SEQ ID NO: 3144 - DNA, 50 bp, Homo sapiens
gccagctatgtcctctaggaaatgacagacccaaccaccagcaataaaca

SEQ ID NO: 3145 - DNA, 50 bp, Homo sapiens
ctgtaaaaagacaattcatctcattgtgagtggaagtagttatctggaat

SEQ ID NO: 3146 - DNA, 50 bp, Homo sapiens
gcatttcagaatgtgtcttttgaagggctataccagttattaaatagtgt

SEQ ID NO: 3147 - DNA, 50 bp, Homo sapiens
ccagggtttctgcactggtcccctcttttcccttcagtcttcttcacttc

SEQ ID NO: 3148 - DNA, 50 bp, Homo sapiens
acactgctacaccattactttcttgagacatttgtaagtcctttgataca

SEQ ID NO: 3149 - DNA, 50 bp, Homo sapiens
tgaataactagtgataccctcaataaaacagggattgccaagaagggaac

SEQ ID NO: 3150 - DNA, 50 bp, Homo sapiens
acctttaacatgtaaagatgctcaccttgttcagaagagaataaaccagt

SEQ ID NO: 3151 - DNA, 50 bp, Homo sapiens
tatgtcataaacatgtaaataaaagatgttgaatcttgttgaaagcgcgg

SEQ ID NO: 3152 - DNA, 50 bp, Homo sapiens
ttgtattctggaagcgtgaattgcttttgaagtctgtcagtattactggt

SEQ ID NO: 3153 - DNA, 50 bp, Homo sapiens
tttgtaagcgaaggagatggaggtcgtcttaaaccagagagctactgaat

SEQ ID NO: 3154 - DNA, 50 bp, Homo sapiens
actcacaacttcttaagctaaatggtattttcatttttctcaagctctcc

SEQ ID NO: 3155 - DNA, 50 bp, Homo sapiens
agtttagcaatatgacattcttggtgacagtggaatctttgtctcttcac

SEQ ID NO: 3156 - DNA, 50 bp, Homo sapiens
gccactgaccttggctcaccttagaggaatttcctcgagaacaacagaga

SEQ ID NO: 3157 - DNA, 50 bp, Homo sapiens
acttctgtctttgctggaaagtgtatttgtgcataaataaagtctgtgta

SEQ ID NO: 3158 - DNA, 50 bp, Homo sapiens
ttctctttcttcacaatgtatgtcctcagtggtacctattattgatgcct

SEQ ID NO: 3159 - DNA, 50 bp, Homo sapiens
ctgtgacccgctcccgcctcatgagcaaggagagtggttcatcaatgatt

SEQ ID NO: 3160 - DNA, 50 bp, Homo sapiens; identical to SEQ ID NO: 77

SEQ ID NO: 3161 - DNA, 50 bp, Homo sapiens
agaacttccaaatgctgagcccagatccaaagttgtcttctgtccacgag

SEQ ID NO: 3162 - DNA, 50 bp, Homo sapiens
tgacaaattagaagaacggcctcacctgccatccaccttcaactacaacc

SEQ ID NO: 3163 - DNA, 50 bp, Homo sapiens
tggatattttaacctgttaagtgtgtgtgtgttttctgtacccaaccaga

SEQ ID NO: 3164 - DNA, 50 bp, Homo sapiens
taaatagggaagatggagacacctctgggggtcctctctgagtcaaatcc

SEQ ID NO: 3165 - DNA, 50 bp, Homo sapiens
tgtgttaggttgaataaggtgtggaaaatgcttttctgttagtagaatgc

SEQ ID NO: 3166 - DNA, 50 bp, Homo sapiens
gcagtaaccactgaacgtcaatcagccctccatggggttctttcgatttt

SEQ ID NO: 3167 - DNA, 50 bp, Homo sapiens
gtttgaagttgtgactctcctgctaccaattaaataaagcttactttgcc

SEQ ID NO: 3168 - DNA, 50 bp, Homo sapiens
tgcaagatgaatggctaatattttggtgcagtgtttgatgttcaaaacaa

SEQ ID NO: 3169 - DNA, 50 bp, Homo sapiens
ctgcctgttcagaactgtttaatagcagttactcttgagtgtatttacct

SEQ ID NO: 3170 - DNA, 50 bp, Homo sapiens
attctagagtttggaatgcaaaattaattgttttaccctcaagctgggaa

SEQ ID NO: 3171 - DNA, 50 bp, Homo sapiens
tggggtgaatttgttaaaatgagtaactttgataaagtttttcatgcaca

SEQ ID NO: 3172 - DNA, 50 bp, Homo sapiens
aaaagtatagagttggaaactctgggaaaacttacggaaatacacaaatg

SEQ ID NO: 3173 - DNA, 50 bp, Homo sapiens; identical to SEQ ID NO: 1619

SEQ ID NO: 3174 - DNA, 50 bp, Homo sapiens
tacaatgcttccaaactggaactctacattttgtatcttttaaagctcct

SEQ ID NO: 3175 - DNA, 50 bp, Homo sapiens; identical to SEQ ID NO: 1584

SEQ ID NO: 3176 - DNA, 50 bp, Homo sapiens; identical to SEQ ID NO: 1632

SEQ ID NO: 3177 - DNA, 50 bp, Homo sapiens
tggtgtttgattattggaatggtgccatattgtcactccttctacttgct

SEQ ID NO: 3178 - DNA, 50 bp, Homo sapiens; identical to SEQ ID NO: 1640

SEQ ID NO: 3179 - DNA, 50 bp, Homo sapiens
ggctaaacgattcttactcagtgtgatgtataatgatgcaacagggaccc

SEQ ID NO: 3180 - DNA, 50 bp, Homo sapiens; identical to SEQ ID NO: 1592

SEQ ID NO: 3181 - DNA, 50 bp, Homo sapiens
ataccttctgaacgggaagagacagccagcacagtgtttatgccactggt

SEQ ID NO: 3182 - DNA, 50 bp, Homo sapiens
ttccactagtatatccctgttgatttgtttgtgccttttattaactgcca

SEQ ID NO: 3183 - DNA, 50 bp, Homo sapiens
tcatctgtgccatgctctagaaccttgaccttgatagttcaccacgtctg

SEQ ID NO: 3184 - DNA, 50 bp, Homo sapiens
actgcccttaactctggtatacaccaaaaagaaatctttactttccttgt

SEQ ID NO: 3185 - DNA, 50 bp, Homo sapiens
aggcagcctttctttaatgttttcagttggtttgtattttgtagctcagt

SEQ ID NO: 3186 - DNA, 50 bp, Homo sapiens
ccagaatggtctttaatgagcatggaacctgagcaaagggaataggtggg

SEQ ID NO: 3187 - DNA, 50 bp, Homo sapiens
tctctctctacactgtggtgcacttaacttgtggaatttttatactaaaa

SEQ ID NO: 3188 - DNA, 50 bp, Homo sapiens
actcagcctaaggaaacaagtacactccacacatgcataaaggaaatcaa

SEQ ID NO: 3189 - DNA, 50 bp, Homo sapiens; identical to SEQ ID NO: 476

SEQ ID NO: 3190 - DNA, 50 bp, Homo sapiens
tttgcatcatgtagtcattgagtgagggggagatataagccaaggatttt

SEQ ID NO: 3191 - DNA, 50 bp, Homo sapiens
gcttacttcacaatgtgcccaggtcagctgtataaaataaatactgcatt

SEQ ID NO: 3192 - DNA, 50 bp, Homo sapiens
tgtaatggttggtttattgttctataaccccagcccatcattttctgtgt

SEQ ID NO: 3193 - DNA, 50 bp, Homo sapiens
agtcaatgtttcgtgttccgcattatttgaaccatttgcccttacagaaa

SEQ ID NO: 3194 - DNA, 50 bp, Homo sapiens
agggagcagtgcttttgggtcctagaacctgttgagtttctaatgaatat

SEQ ID NO: 3195 - DNA, 50 bp, Homo sapiens
aatgacttgttatagctcagtgtgcccttgaatccatacagtttcttaaa

SEQ ID NO: 3196 - DNA, 50 bp, Homo sapiens
tgttttgttttctgggttttgttttttgtttttgtctgtgcaagacctgc

SEQ ID NO: 3197 - DNA, 50 bp, Homo sapiens; identical to SEQ ID NO: 455

SEQ ID NO: 3198 - DNA, 50 bp, Homo sapiens
cctgacctgtgcaataaggattgttccctgcgaagttttgttggatgtaa

SEQ ID NO: 3199 - DNA, 50 bp, Homo sapiens
gagtctggggtaagggtgggggttgaaagttgttatctttaaatacatgt

SEQ ID NO: 3200 - DNA, 50 bp, Homo sapiens
ttgatctgccaaggatttcctctcagagctgttgcacagacagagattgt

SEQ ID NO: 3201 - DNA, 50 bp, Homo sapiens
gggggtttccacaatgtgagggggaaccaagaaaattttaaatacagtgt

SEQ ID NO: 3202 - DNA, 50 bp, Homo sapiens
tgcctgtcccaagttttgttccattttttaaaaatttgttgtaaactgca

SEQ ID NO: 3203 - DNA, 50 bp, Homo sapiens
tattgttacatatgtttgcatcaagctagcagccaagaggttaattgtgc

SEQ ID NO: 3204 - DNA, 50 bp, Homo sapiens
aaaccagaacaagcaacaaactgtatttatgcaagcaaaattgatgagaa

SEQ ID NO: 3205 - DNA, 50 bp, Homo sapiens
tgatgtttctgaatactaccaaacagccatacatgtctgcaatgaagaga

SEQ ID NO: 3206 - DNA, 50 bp, Homo sapiens
tatcatcctccttctcaacccatctccctaaccccacatgcttgccagtt

SEQ ID NO: 3207 - DNA, 50 bp, Homo sapiens
ttctgaaattgggaaacatttattttaaatgcaatcaggtagtgttgctt

SEQ ID NO: 3208 - DNA, 50 bp, Homo sapiens
gactgaatttgacatctggtatgctggtatgtagctcatacatcaagagt

SEQ ID NO: 3209 - DNA, 50 bp, Homo sapiens
ttgtacttttcagaaccattttgtctcattattcctgttttagctgaaga

SEQ ID NO: 3210 - DNA, 50 bp, Homo sapiens
ctggctgtgtcacagggtgagccccaaaattggggttcagcgtgggaggc

SEQ ID NO: 3211 - DNA, 50 bp, Homo sapiens
aatggtcccctgtgtttgtagagaactcccttatacagagttttggttct

SEQ ID NO: 3212 - DNA, 50 bp, Homo sapiens
ttctttcatgtcctccctacttcctcagtgtcaatcagattaaagtgtgt

SEQ ID NO: 3213 - DNA, 50 bp, Homo sapiens
tttgaactttggtcatagagtcttcatatttcagtatttggtggtcccta

SEQ ID NO: 3214 - DNA, 50 bp, Homo sapiens
accctagagttactctcttttgggaacataaggaggtatacagaactgca

SEQ ID NO: 3215 - DNA, 50 bp, Homo sapiens
ttgatgtgtcacaaaacattactcatttgatttcccccacccccgccaac

SEQ ID NO: 3216 - DNA, 50 bp, Homo sapiens
tcagggcgtttgaatgtgaattaggaccagcgcaatgaatgctcaagttg

SEQ ID NO: 3217 - DNA, 50 bp, Homo sapiens
agttcccagtctcttctgtcctgcagcccttgcctctttcccacaggttc

SEQ ID NO: 3218 - DNA, 50 bp, Homo sapiens
gtagaatcaggcactgctcgcagaaggaacacagattgtagagattaaca

SEQ ID NO: 3219 - DNA, 50 bp, Homo sapiens
ttttctcagcgcagttttgttttgtgtgtccattggattacaaactttat

SEQ ID NO: 3220 - DNA, 50 bp, Homo sapiens
tgcctcattatcttgcagctgtaaacatattggaatgtacatgtcaataa

SEQ ID NO: 3221 - DNA, 50 bp, Homo sapiens
gccatagcctgaatcttttaggggtattaaggtcagcctctcactcttcc

SEQ ID NO: 3222 - DNA, 50 bp, Homo sapiens
agccgccttccaggcccgctatgcagacatctttccctccaaggtttgtc

SEQ ID NO: 3223 - DNA, 50 bp, Homo sapiens
agcagctttcttcaagtcgctctttagccctttgtggttaatctctcagt

SEQ ID NO: 3224 - DNA, 50 bp, Homo sapiens
tgcactgatacaacattaccattcttctatggaaagaaaacttttgatga

SEQ ID NO: 3225 - DNA, 50 bp, Homo sapiens
atagaggaggaggcacttcaggggtgaggcggaggaggagtcaacgtatt

SEQ ID NO: 3226 - DNA, 50 bp, Homo sapiens
atacccacacagcaactggtccactgctttactgtctgttggataatggc

SEQ ID NO: 3227 - DNA, 50 bp, Homo sapiens
agatttgtgtcctctcattccctctcttcctcttgtaagtgcccttctaa

SEQ ID NO: 3228 - DNA, 50 bp, Homo sapiens
gcactgtttttaaacccaagtaaagactgcttgaaacctgttgatggaaa

SEQ ID NO: 3229 - DNA, 50 bp, Homo sapiens
agatttcccctcagtttccattgacttagatcaggttacagagaaaggca

SEQ ID NO: 3230 - DNA, 50 bp, Homo sapiens
agatcgagatcttcagtcctctgcttcatctgtgagcttgccttcagtca

SEQ ID NO: 3231 - DNA, 50 bp, Homo sapiens; identical to SEQ ID NO: 1184

SEQ ID NO: 3232 - DNA, 50 bp, Homo sapiens
tggcactctgtggctccttgtagtattatagctatactgggaaagcatag

SEQ ID NO: 3233 - DNA, 50 bp, Homo sapiens; identical to SEQ ID NO: 1204

SEQ ID NO: 3234 - DNA, 50 bp, Homo sapiens
aattgaccaacctaatgttacaactactttgaggtggccaaatgtaaact

SEQ ID NO: 3235 - DNA, 50 bp, Homo sapiens
ctactacgctgccctgggtgctgtaggagcccatctgactcaccagaaat

SEQ ID NO: 3236 - DNA, 50 bp, Homo sapiens
aaggcctcagttttaattattttcttcccaaaataaatcacacatttggt

SEQ ID NO: 3237 - DNA, 50 bp, Homo sapiens
ggtggggtgatagggtgggctaaaaaccatgcactctggaatttgttgta

SEQ ID NO: 3238 - DNA, 50 bp, Homo sapiens
agaggcagcttctagacagagttgcttaatgaaagggtttgtaatacttt

SEQ ID NO: 3239 - DNA, 50 bp, Homo sapiens; identical to SEQ ID NO: 1582

SEQ ID NO: 3240 - DNA, 50 bp, Homo sapiens
caacggccaggagaagcactttaaggacgaggacgaggacgaggacgtgg

SEQ ID NO: 3241 - DNA, 50 bp, Homo sapiens
atacagccccggcagaaaacgcctaaagtcagatgagagaccagtacata

SEQ ID NO: 3242 - DNA, 50 bp, Homo sapiens
accagaaacttcaaatgtgtcacaaaagatgagcagaactatcccgaggt

SEQ ID NO: 3243 - DNA, 50 bp, Homo sapiens
aaagcgaagtcatgggagagccacacttgatggtggaatataaacttggt

SEQ ID NO: 3244 - DNA, 50 bp, Homo sapiens
tccctgccataacatcttttgccacgtatagctggaattaagtgttgtct

SEQ ID NO: 3245 - DNA, 50 bp, Homo sapiens
ctggtgactccacacttccaacctgctctaaaaaacgcaaaatagaacag

SEQ ID NO: 3246 - DNA, 50 bp, Homo sapiens
tgtgtagtggatggagtttactgtttgtggaataaaaacggctgtttccg

SEQ ID NO: 3247 - DNA, 50 bp, Homo sapiens
acagggatttcttatgtctttggctacactagatattttgtgattggcaa

SEQ ID NO: 3248 - DNA, 50 bp, Homo sapiens
aggcctgagtgtgtgcgggagaccaaataaaccggcttgggtgcgcaaaa

SEQ ID NO: 3249 - DNA, 50 bp, Homo sapiens
aagaaagaagagagagaacttgatgccaagtccacgaaaaaacaattttt

SEQ ID NO: 3250 - DNA, 50 bp, Homo sapiens
gatccagctgtgcttaagagccagtaatgtcttaataaacatgtggcagc

SEQ ID NO: 3251 - DNA, 50 bp, Homo sapiens
aagcacttgttttattttgtgtgtggagtataaaggctacacccttattg

SEQ ID NO: 3252 - DNA, 50 bp, Homo sapiens
cctttttctacagaatcatcaggcatgggtaaggtggctaacgctgagat

SEQ ID NO: 3253 - DNA, 50 bp, Homo sapiens
tgggtatgttctagagatttaccaccattgcttattgcttttttctttaa

SEQ ID NO: 3254 - DNA, 50 bp, Homo sapiens
tcttcttgatagatgaggccatggtgtaaatggaagtttcagagaggaca

SEQ ID NO: 3255 - DNA, 50 bp, Homo sapiens
gtgggttggtcccactaatggaaatggaaatgcctgagccaggccagcgg

SEQ ID NO: 3256 - DNA, 50 bp, Homo sapiens
aatctattcctgcacctgttacggtttctggaagcagttaataaaaagta

SEQ ID NO: 3257 - DNA, 50 bp, Homo sapiens
gcatggagtcaggagaaaaccaccttcataaactgctctgtgcaaagagg

SEQ ID NO: 3258 - DNA, 50 bp, Homo sapiens
acaaatgcccctgtttatcaataggtgactacttactacacatggaacca

SEQ ID NO: 3259 - DNA, 50 bp, Homo sapiens
tgattatatgcagattcctagtagcatgccttacctacagcactatgtgc

SEQ ID NO: 3260 - DNA, 50 bp, Homo sapiens
ggtcattgagcctcaggtagggaatatatcaacccgatttcttcctctct

SEQ ID NO: 3261 - DNA, 50 bp, Homo sapiens
tttcaaagtgcccagactgtgtacaaagacacatgtaatggagattgtac

SEQ ID NO: 3262 - DNA, 50 bp, Homo sapiens
aggaccgaagtgtttcaagtggatctcagtaaaggatctttggagccaga

SEQ ID NO: 3263 - DNA, 50 bp, Homo sapiens
agtttcactgtcagagatattgtaggtgctaatactggatttcgtctcag

SEQ ID NO: 3264 - DNA, 50 bp, Homo sapiens
agttagaagagcaatatgtttccttctctgtaacagtgtcctaacagtga

SEQ ID NO: 3265 - DNA, 50 bp, Homo sapiens
agctgccacttcccagaagcctacataattatttgctctatgaagacgtt

SEQ ID NO: 3266 - DNA, 50 bp, Homo sapiens
gccactaataacattgggctaatatctgctgtgcttctctgacaggtagt

SEQ ID NO: 3267 - DNA, 50 bp, Homo sapiens
agcatgcagttctctgtgaaatctcaaatattgttgtaatagtctgtttc

SEQ ID NO: 3268 - DNA, 50 bp, Homo sapiens
tgaatctatcccccaagaaaccatcttatccctgtaataaatcagcatgt

SEQ ID NO: 3269 - DNA, 50 bp, Homo sapiens
gtgcttccaggcggcactgacagcctcagtaacaataaaaacaatggtag

SEQ ID NO: 3270 - DNA, 50 bp, Homo sapiens
gtccatgtttctaggggtattcatttgctttctcgttgaaacctgttgtt

SEQ ID NO: 3271 - DNA, 50 bp, Homo sapiens
taggtccataaatgttgtaataaatattcctttgatcttggtgtttgcgt

SEQ ID NO: 3272 - DNA, 50 bp, Homo sapiens
gctagtacctgttatttattacctggaggcctgtccagcacccaccctac

SEQ ID NO: 3273 - DNA, 50 bp, Homo sapiens
cccactatgcacagattaaacttcacctacaaactccttaatatgatctg

SEQ ID NO: 3274 - DNA, 50 bp, Homo sapiens
tgtgctctgttttaccttactctgtttagaaaagtatacaagcgtgtttt

SEQ ID NO: 3275 - DNA, 50 bp, Homo sapiens
tgagtgtgtctctggattttgaccccttattgattcattgtaatatgtaa

SEQ ID NO: 3276 - DNA, 50 bp, Homo sapiens
acatttgtaagggctctcaaagattcacacatgcctatattatcataaga

SEQ ID NO: 3277 - DNA, 50 bp, Homo sapiens
tccgcatccattatttaaaccagtggaaattgtctctatttttggaaagt

SEQ ID NO: 3278 - DNA, 50 bp, Homo sapiens
acggagctgtagtgccattagaaactgtgaatttccaaataaatctgaac

SEQ ID NO: 3279 - DNA, 50 bp, Homo sapiens
agccttcagtttcttaaatgaaatcaaatgttccttcagtacaggtaact

SEQ ID NO: 3280 - DNA, 50 bp, Homo sapiens
ccagacccccatcacttgatgggccacacaagtttgagagtggtacaagg

SEQ ID NO: 3281 - DNA, 50 bp, Homo sapiens
tcaggttaaacccagcagcagcaaagaactccccagtgacttccagttat

SEQ ID NO: 3282 - DNA, 50 bp, Homo sapiens
ggtgggcatttttgggctacctggttcgtttttataagattttgctgggt

SEQ ID NO: 3283 - DNA, 50 bp, Homo sapiens
agtgcaataatactgtatagctttcccccacctcccacaaaatcacccag

SEQ ID NO: 3284 - DNA, 50 bp, Homo sapiens
aatcatgttgcagaaccagcaggtggatagtatataggtttatgcctggg

SEQ ID NO: 3285 - DNA, 50 bp, Homo sapiens
ggtgcagcgtgtcagacacaacattcatgttactcttacattggaatctg

SEQ ID NO: 3286 - DNA, 50 bp, Homo sapiens
ggactgacaccacagatgacagccccacctccttgagctttatttaccta

SEQ ID NO: 3287 - DNA, 50 bp, Homo sapiens
acgacccattttgcaagacttaaagccggaagaacacattttcagattgt

SEQ ID NO: 3288 - DNA, 50 bp, Homo sapiens
aggaattactgtaacaaaatatgtatgtccgaagggaaaaagctgcaagg

SEQ ID NO: 3289 - DNA, 50 bp, Homo sapiens
tcctgtggaatctgatatgtctggtagcatgtcattgatgggacatgaag

SEQ ID NO: 3290 - DNA, 50 bp, Homo sapiens
atggcactaggcagcatttgtatagtaactaatggcaaaaattcatggct

SEQ ID NO: 3291 - DNA, 50 bp, Homo sapiens
atttgattaaaattatttcccactgacctaaactttcagtgatttgtggg

SEQ ID NO: 3292 - DNA, 50 bp, Homo sapiens
aaagcaagtgttttgtacatttcttttcaaaaagtgccaaatttgtcagt

SEQ ID NO: 3293 - DNA, 50 bp, Homo sapiens
aatctgcactgatattacatccacagtaccacagtatttatgtgtatgaa

SEQ ID NO: 3294 - DNA, 50 bp, Homo sapiens
atggtagctgagccaaacacgtaggatttccgttttaaggttcacatgga

SEQ ID NO: 3295 - DNA, 50 bp, Homo sapiens
aagccagaacctgctgttttcagggtgggtgatgtaaatatagtgtgtac

SEQ ID NO: 3296 - DNA, 50 bp, Homo sapiens; identical to SEQ ID NO: 3162

SEQ ID NO: 3297 - DNA, 50 bp, Homo sapiens
tctttctggtttctggagataacccatcaataaaagctgcttcctctggt

SEQ ID NO: 3298 - DNA, 50 bp, Homo sapiens
gggacccctcctacccttgactcctctgtgctttggtaataaattgtttt

SEQ ID NO: 3299 - DNA, 50 bp, Homo sapiens
gttctgaatgctgtcctcaaagtatataatgtttcatgtaccaagaccct

SEQ ID NO: 3300 - DNA, 50 bp, Homo sapiens
gacatctgctccctcctcctgcaacacagcccagccctgaaggccatccg

SEQ ID NO: 3301 - DNA, 50 bp, Homo sapiens
tgggaagatcctgacctcctccaaggaagaaatccagaaagccttaagac

SEQ ID NO: 3302 - DNA, 50 bp, Homo sapiens
agccagtgatctctctgactttcaatcagtttccaagcttaaccagggca

SEQ ID NO: 3303 - DNA, 50 bp, Homo sapiens
aaacgcatccgctatctctacaaacactttaaccgacatgggaagtttcg

SEQ ID NO: 3304 - DNA, 50 bp, Homo sapiens; identical to SEQ ID NO: 745

SEQ ID NO: 3305 - DNA, 50 bp, Homo sapiens
ttccaggcttttgctactcttcactcagctacaataaacatcctgaatgt

SEQ ID NO: 3306 - DNA, 50 bp, Homo sapiens
acacctagtcatagaaatcagtctctctggtttgttttgtattatgttgt

SEQ ID NO: 3307 - DNA, 50 bp, Homo sapiens
cactgcttccttctgctccaggcctcaattttcccttcttgtaaaatgga

SEQ ID NO: 3308 - DNA, 50 bp, Homo sapiens
actttcggagggagtttattattgagtctttatctgtgacagtatttgga

SEQ ID NO: 3309 - DNA, 50 bp, Homo sapiens
atagagaggtaattaaattgctggagccaactatttcacaacttctgtaa

SEQ ID NO: 3310 - DNA, 50 bp, Homo sapiens
gttccaccagtatttaccaggaaaacaaagaatgtgttaagggatgctcc

SEQ ID NO: 3311 - DNA, 50 bp, Homo sapiens
tgctatttcctattttcaccaaaattggggaaggagtgccactttccagc

SEQ ID NO: 3312 - DNA, 50 bp, Homo sapiens
tgctgccacttttcaattctgtcagtgcttccacatggaaacaaaatgca

SEQ ID NO: 3313 - DNA, 50 bp, Homo sapiens
tcactttctgtattttaattttgttgaagggctgattgggatttccatgt

SEQ ID NO: 3314 - DNA, 50 bp, Homo sapiens
gcatgaagagacatagccttttagttttgctaattgtgaaatggaaatgc

SEQ ID NO: 3315 - DNA, 50 bp, Homo sapiens
tgttgtccctgaacttagctaaatggtgcaacttagtttctccttgcttt

SEQ ID NO: 3316 - DNA, 50 bp, Homo sapiens
tcatagtgtcagtgaggtcccgtgagtctttgtgagtccttgtgtcatcg

SEQ ID NO: 3317 - DNA, 50 bp, Homo sapiens
gtgcgtagaatattacgtatgcatgttcatgtctaaagaatggctgttga

SEQ ID NO: 3318 - DNA, 50 bp, Homo sapiens; identical to SEQ ID NO: 1463

SEQ ID NO: 3319 - DNA, 50 bp, Homo sapiens
ggacattggttattttatgctttcttggatataaccatgatcagagtgcc

SEQ ID NO: 3320 - DNA, 50 bp, Homo sapiens
gcaagtgtaggagtggtgggcctgaactgggccattgatcagactaaata

SEQ ID NO: 3321 - DNA, 50 bp, Homo sapiens
aatcagaagagcctggaaaaagacctagcccaacttcccttgtgggaaac

SEQ ID NO: 3322 - DNA, 50 bp, Homo sapiens
tcaacaaaggggattttgtacacataacatgggttatttagtttaactct

SEQ ID NO: 3323 - DNA, 50 bp, Homo sapiens
cttttgtgcagcgactatgttggtgttaggggtggtgtggagattgttaa

SEQ ID NO: 3324 - DNA, 50 bp, Homo sapiens
atttatgccttaaatgttttcttccccattccttcctccccctcggtagg

SEQ ID NO: 3325 - DNA, 50 bp, Homo sapiens
tttgtatttgtgaactcatctgtgggaggagtaaagaaaatccaaaagca

SEQ ID NO: 3326 - DNA, 50 bp, Homo sapiens
cccccgtgggcatggaccacctttattttatacaaaattaaaaacaagtt

SEQ ID NO: 3327 - DNA, 50 bp, Homo sapiens
actgtaaactaatctgtcattgtttttaccttccttttctttttcagtgc

SEQ ID NO: 3328 - DNA, 50 bp, Homo sapiens
tacttgctgtggtggtcttgtgaaaggtgatgggttttattcgttgggct

SEQ ID NO: 3329 - DNA, 50 bp, Homo sapiens
aaagaattagtgtatgcttcctgaataaaaaggagccaaagttgatcaga

SEQ ID NO: 3330 - DNA, 50 bp, Homo sapiens; identical to SEQ ID NO: 1251

SEQ ID NO: 3331 - DNA, 50 bp, Homo sapiens
agcttaaggttttaaaaatgttgcccgtaatgttgaacgtgtctgttaga

SEQ ID NO: 3332 - DNA, 50 bp, Homo sapiens
ggatgcacgtacagaatacattcagccgtcaggtaataacatgaagcagt

SEQ ID NO: 3333 - DNA, 50 bp, Homo sapiens
ggacagtttctattgcttttccttttttccatcccttccctaccatcaaa

SEQ ID NO: 3334 - DNA, 50 bp, Homo sapiens
agacttacattactgctttaacgtgtatatcactgggcatccccaagggc

SEQ ID NO: 3335 - DNA, 50 bp, Homo sapiens
gtcaggttaggtcaaagccagggagtgacagaatctgggaaatcaaacaa

SEQ ID NO: 3336 - DNA, 50 bp, Homo sapiens
cctcttgatgcctaagcaggtaagcagatgcctaagctgtatttctccaa

SEQ ID NO: 3337 - DNA, 50 bp, Homo sapiens
tggatctgtcaaactaacacttatgcctttagtctcattgtatgaggtgt

SEQ ID NO: 3338 - DNA, 50 bp, Homo sapiens
acctgccatcattggtctttactaagtgaagtgacttctttctttaacaa

SEQ ID NO: 3339 - DNA, 50 bp, Homo sapiens
gctgccaactgtagtaatgatgcttttaataaaagtgacccatgatatgc

SEQ ID NO: 3340 - DNA, 50 bp, Homo sapiens
actgttgtccccccacccttttttccttaaataaagtaaaaatgacaccc

SEQ ID NO: 3341 - DNA, 50 bp, Homo sapiens
tgtgaatactgtgtagcaggatcttgagagtccttgttcttacataggca

SEQ ID NO: 3342 - DNA, 50 bp, Homo sapiens
aagaggcttccatccctccttccttctttcctcctacagtgctgagcaaa

SEQ ID NO: 3343 - DNA, 50 bp, Homo sapiens
gttgaattggggtggatggggggagcaagcataatttttaagtgtgaagc

SEQ ID NO: 3344 - DNA, 50 bp, Homo sapiens; identical to SEQ ID NO: 876

SEQ ID NO: 3345 - DNA, 50 bp, Homo sapiens
cccactgaagtctttgggtagctcttaagccataactaaggagcagcatt

SEQ ID NO: 3346 - DNA, 50 bp, Homo sapiens
agtgacgaggaggaagtggcctacacgggttagctgcccagtgagccatc

SEQ ID NO: 3347 - DNA, 50 bp, Homo sapiens
aacagaagtcaagagaacatagaccaacttgctgcatgagtaaggtggct

SEQ ID NO: 3348 - DNA, 50 bp, Homo sapiens
ttttccctgctattgaggaagtattttgccttccctactcactgagaagt

SEQ ID NO: 3349 - DNA, 50 bp, Homo sapiens
cggaaccagaatttgatctcaactatgttccactaaaggcacaggaatgg

SEQ ID NO: 3350 - DNA, 50 bp, Homo sapiens
cgcaccttgtgtcttgtagggtatggtatgtgggacttcgctgtttttat

SEQ ID NO: 3351 - DNA, 50 bp, Homo sapiens
agcagttatattgccccttggtttttattcagtttaactactgtttccaa

SEQ ID NO: 3352 - DNA, 50 bp, Homo sapiens
agcaaaatcctcagaaatggtctaaataaaacacttgatatgcctagaga

SEQ ID NO: 3353 - DNA, 50 bp, Homo sapiens; identical to SEQ ID NO: 879

SEQ ID NO: 3354 - DNA, 50 bp, Homo sapiens
ttacctggattccattggctggttttaccactcctatcagattgtagtgt

SEQ ID NO: 3355 - DNA, 50 bp, Homo sapiens
ctctttgccctctatcctgagtaactaatggacatcttctcatgcaaggt

SEQ ID NO: 3356 - DNA, 50 bp, Homo sapiens
gccacagaatggtcacccagcttatttaggtgtagacaagtatgacacag

SEQ ID NO: 3357 - DNA, 50 bp, Homo sapiens
gccacagaggctccaatacctgggaatgttcacaaagtcatcaactggaa

SEQ ID NO: 3358 - DNA, 50 bp, Homo sapiens
agaatgtgtgtgcctgtgggtctctacaagtgacagatgtgttgttttca

SEQ ID NO: 3359 - DNA, 50 bp, Homo sapiens
tccaaattgtttcctaacattctattttatgcctttgcgtattaaacgtg

SEQ ID NO: 3360 - DNA, 50 bp, Homo sapiens
gcctctactgtggcctcaaccctggcaattatagctactcccatccctta

SEQ ID NO: 3361 - DNA, 50 bp, Homo sapiens
aactgaacacaattttgggacaacgtttaaacattacttttcatacttga

SEQ ID NO: 3362 - DNA, 50 bp, Homo sapiens
ctcagcccagcccgcctgtccctagattcagccacatcagaaataaactg

SEQ ID NO: 3363 - DNA, 50 bp, Homo sapiens
actgtgccatggacatttttcctctggggaattaacatctaaattctggt

SEQ ID NO: 3364 - DNA, 50 bp, Homo sapiens
acaacgctcttagagaatccgtgaatgtgaacagacaaatgtggctaacc

SEQ ID NO: 3365 - DNA, 50 bp, Homo sapiens
taggagaataagagtctggagactgggagccttcacttcggcctccgatt

SEQ ID NO: 3366 - DNA, 50 bp, Homo sapiens
tgctgagtggttacactttgcaagctgtggtgaagatcacactgtgaaga

SEQ ID NO: 3367 - DNA, 50 bp, Homo sapiens
cccagtgctgatggagatgccactttcgtgtgactgcgaacattaaagca

SEQ ID NO: 3368 - DNA, 50 bp, Homo sapiens
tgttcaggatctcctcccttgtttaaatgtcaataaatgccccaactgct

SEQ ID NO: 3369 - DNA, 50 bp, Homo sapiens
ttattcatatattcctgtccaaagccacactgaaaacagaggcagagaca

SEQ ID NO: 3370 - DNA, 50 bp, Homo sapiens
aggtcatccacacacttctgcccccactgcattgaattttttgcttatgt

SEQ ID NO: 3371 - DNA, 50 bp, Homo sapiens
ttttcgttctcctcctaccccagatctctacaaggacattgcccctaagc

SEQ ID NO: 3372 - DNA, 50 bp, Homo sapiens
gtgtttgtaattcttctttgtccttttacctacagaaatggtcacatggt

SEQ ID NO: 3373 - DNA, 50 bp, Homo sapiens
aggatgtttgtagtgctataatatagaatgggatttactctgctttacca

SEQ ID NO: 3374 - DNA, 50 bp, Homo sapiens
agctaattatctctttgagtccttgcttctgtttgctcacagtaagctca

SEQ ID NO: 3375 - DNA, 50 bp, Homo sapiens
tcctacttatttaagctatttgagctccgggtctcttctacctgcattct

SEQ ID NO: 3376 - DNA, 50 bp, Homo sapiens
agtgattgccacctaaatcagaagacgttctaaagtcagtaagaaagtgt

SEQ ID NO: 3377 - DNA, 50 bp, Homo sapiens
cacgcttagggcagggatctgggaaattccagtgatctcctttagcagag

SEQ ID NO: 3378 - DNA, 50 bp, Homo sapiens
tttctaatcgaggtgtgaaaaagttctaggttcagttgaagttctgatga

SEQ ID NO: 3379 - DNA, 50 bp, Homo sapiens
tcattctgtttttgatgaacatttggaaactgtcgggctttttattaaag

SEQ ID NO: 3380 - DNA, 50 bp, Homo sapiens
caatgccctgtgttaaattgtttaaaagtttcccttttcttttttgccaa

SEQ ID NO: 3381 - DNA, 50 bp, Homo sapiens
acctattgcatggaaagatgctcattatagtgaagttaataaagcacctt

SEQ ID NO: 3382 - DNA, 50 bp, Homo sapiens
agaggactatagtggaagtgaaagcattctgtgtttactctttgcattaa

SEQ ID NO: 3383 - DNA, 50 bp, Homo sapiens
tgaattgcactgtgaaaagcactcttccctctcagttttcgttcatcctg

SEQ ID NO: 3384 - DNA, 50 bp, Homo sapiens
ccatggggtcagaagggcacggtagttcttgcaattatttttgttttacc

SEQ ID NO: 3385 - DNA, 50 bp, Homo sapiens
aatgtgggaaggatttatttacagtgtgttgtaattttgtaaggccaact

SEQ ID NO: 3386 - DNA, 50 bp, Homo sapiens
agctactgtgacagaaacagaaaagcagtggacaacacgtttccaagaag

SEQ ID NO: 3387 - DNA, 50 bp, Homo sapiens
tgctcatgctgacttaaaacactagcagtaaaacgctgtaaactgtaaca

SEQ ID NO: 3388 - DNA, 50 bp, Homo sapiens
tccaatgcagtcccattctttatggcctatagtctcactcccaactaccc

SEQ ID NO: 3389 - DNA, 50 bp, Homo sapiens
ggtgtctgacttaatgactcctgctgaagttgaattgtgagatgttatcc

SEQ ID NO: 3390 - DNA, 50 bp, Homo sapiens
catttgtctggaaatgctgccgggagcctattgtgtaaatgtaggtattt

SEQ ID NO: 3391 - DNA, 50 bp, Homo sapiens; identical to SEQ ID NO: 814

SEQ ID NO: 3392 - DNA, 50 bp, Homo sapiens
caggtcaacccccaccggacctacaacccgcagtcccacatcatctcagg

SEQ ID NO: 3393 - DNA, 50 bp, Homo sapiens; identical to SEQ ID NO: 3392

SEQ ID NO: 3394 - DNA, 50 bp, Homo sapiens
tttagggttgtgactggctttggtgcaaatgtgtgctcaagctaataagt

SEQ ID NO: 3395 - DNA, 50 bp, Homo sapiens
acttgtgttttgtttgggggctgggaaatgtatttttacattgtagccaa

SEQ ID NO: 3396 - DNA, 50 bp, Homo sapiens
aacattgtgctctaacagtatgactattctttcccccactcttaaacagt

SEQ ID NO: 3397 - DNA, 50 bp, Homo sapiens
ccaagggaggagggaggaggtaaaaggcagggagttaataacatgaatta

SEQ ID NO: 3398 - DNA, 50 bp, Homo sapiens
tactctttggcatccagtctctcgtggcgattgattatgcttgtgtgagg

SEQ ID NO: 3399 - DNA, 50 bp, Homo sapiens
ccttccagaagctacgaaaaagggagctgtttaaatttaataaatctctg

SEQ ID NO: 3400 - DNA, 50 bp, Homo sapiens
aagtgccatagaagaccaataactgtttagttgaggctagtctggaacct

SEQ ID NO: 3401 - DNA, 50 bp, Homo sapiens
tggattcaagttactgaagtgaataccaataaaaagaaaaccctaggcca

SEQ ID NO: 3402 - DNA, 50 bp, Homo sapiens
aggagtggatcccaccttcaacaccttacaagtaaagacaatgaagaaca

SEQ ID NO: 3403 - DNA, 50 bp, Homo sapiens
cagtaatagctgaacctgttcaaaatgttaataaaggtttcgttgcatgg

SEQ ID NO: 3404 - DNA, 50 bp, Homo sapiens
agggagtggggaggtggtaagaacacctgacaacttctgaatattggaca

SEQ ID NO: 3405 - DNA, 50 bp, Homo sapiens
aaaattagtggattgactccactttgttgtgttgttttcattgttgaaaa

SEQ ID NO: 3406 - DNA, 50 bp, Homo sapiens
aatggaggcacgaacgcaggggccaaatagcaataaatgggttttgtttt

SEQ ID NO: 3407 - DNA, 50 bp, Homo sapiens
tgttttgattgttttgcaaggaagaaagacaatggaataacataccttca

SEQ ID NO: 3408 - DNA, 50 bp, Homo sapiens
tcattgctgtctacaggtttctttcagattatgttcatgggtttgtgtgt

SEQ ID NO: 3409 - DNA, 50 bp, Homo sapiens
gaaaacagaccttgtgctgaggacacgtcaataaaaattataccttcccc

SEQ ID NO: 3410 - DNA, 50 bp, Homo sapiens
gggataccagctgagtctgaattctgctctaaataaagacgactacagag

SEQ ID NO: 3411 - DNA, 50 bp, Homo sapiens
tggctcggataagagatgggacatcattcagtcactagttggatggcaca

SEQ ID NO: 3412 - DNA, 50 bp, Homo sapiens
aacttgatgaaagtattgcagtattgatgccattgtagaatagaactgga

SEQ ID NO: 3413 - DNA, 50 bp, Homo sapiens
tttgtgtgttgggaccaaacagttgtcaataaactttacaagcgagcatc

SEQ ID NO: 3414 - DNA, 50 bp, Homo sapiens; identical to SEQ ID NO: 1675

SEQ ID NO: 3415 - DNA, 50 bp, Homo sapiens
aggtggtcaatgaatgttttgatgaaatgaatgtttttgtataatggcct

SEQ ID NO: 3416 - DNA, 50 bp, Homo sapiens
acgggacaattttaagatgtaataccaatactttagaagtttggtcgtgt

SEQ ID NO: 3417 - DNA, 50 bp, Homo sapiens; identical to SEQ ID NO: 612

SEQ ID NO: 3418 - DNA, 50 bp, Homo sapiens; identical to SEQ ID NO: 612

SEQ ID NO: 3419 - DNA, 50 bp, Homo sapiens
acttttatgtaaaaaagtgcacctttagttttacaagtaaagcaggttgt

SEQ ID NO: 3420 - DNA, 50 bp, Homo sapiens
tcttaataataatgaagacgacttaccctgtggaattgaacacactggtg

SEQ ID NO: 3421 - DNA, 50 bp, Homo sapiens
gctgctgtgtgtatttatgaatattaatgaataaaaactgcttggatggt

SEQ ID NO: 3422 - DNA, 50 bp, Homo sapiens; identical to SEQ ID NO: 812

SEQ ID NO: 3423 - DNA, 50 bp, Homo sapiens
taaatttatttatttatgaaaaaacctcgtgccgaattcttggcctcgag

SEQ ID NO: 3424 - DNA, 50 bp, Homo sapiens
gggtttccgctggctctcccagtatattgactgatgtttggacggtgaaa

SEQ ID NO: 3425 - DNA, 50 bp, Homo sapiens
gtacagttactcatgtcattgtaatgatttcactcctaactgtgacattt

SEQ ID NO: 3426 - DNA, 50 bp, Homo sapiens
actgagttgtcagaaattatgtcaaaatgaaaactgtttgtttcatgaca

SEQ ID NO: 3427 - DNA, 50 bp, Homo sapiens
acctgacttcaccatgtttattccctttgcctacaaccagttaatatctg

SEQ ID NO: 3428 - DNA, 50 bp, Homo sapiens
tcatgcgtgaacaatttaaaaaacgacagaataaggtacaaatgtagtgt

SEQ ID NO: 3429 - DNA, 50 bp, Homo sapiens
cccatcccccctccccacccccatccccaatacagctacgtttgtacatc

SEQ ID NO: 3430 - DNA, 50 bp, Homo sapiens
ccaacaaaattgggatcatccaaactgagtccatctggctaattctaaat

SEQ ID NO: 3431 - DNA, 50 bp, Homo sapiens
tgactggaactgagagtaaattgggaatgtatgaccaatcttagaccctg

SEQ ID NO: 3432 - DNA, 50 bp, Homo sapiens
tgtttaaatgatggtgaatactttcttaacactggtttgtctgcatgtgt

SEQ ID NO: 3433 - DNA, 50 bp, Homo sapiens
acctaaggtcaagctgggagagagaaatgactgagatgaatgtctttact

SEQ ID NO: 3434 - DNA, 50 bp, Homo sapiens
gcttagggaaatttcacagttcattgtggagtgttaaacttagaacatgt

SEQ ID NO: 3435 - DNA, 50 bp, Homo sapiens
tgttacaggtttccaaggtggacttgaacagatggccttatattaccaaa

SEQ ID NO: 3436 - DNA, 50 bp, Homo sapiens
tgttactgctttgccagttctacgttatttacaattattcagctcttgca

SEQ ID NO: 3437 - DNA, 50 bp, Homo sapiens
tttctgtattgcagtgtttataggcttcttgtgtgttaaacttgatttca

SEQ ID NO: 3438 - DNA, 50 bp, Homo sapiens; identical to SEQ ID NO: 860

SEQ ID NO: 3439 - DNA, 50 bp, Homo sapiens
gtttgtgttaccctcctgtaaatggtgtacataatgtattgttggtaatt

SEQ ID NO: 3440 - DNA, 50 bp, Homo sapiens
gctcaccatacggctctaacagattaggggctaaaacgattactgacttt

SEQ ID NO: 3441 - DNA, 50 bp, Homo sapiens
cggctgatgggacaggaattgaagaagagaattgactcgtatgaacagga

SEQ ID NO: 3442 - DNA, 50 bp, Homo sapiens
tggtgctacgaagccatttctcttgatttttagtaaacttttatgacagc

SEQ ID NO: 3443 - DNA, 50 bp, Homo sapiens
tgagaaactgtttgacctggttcgaagaatgttagaatatgatccaactc

SEQ ID NO: 3444 - DNA, 50 bp, Homo sapiens
ggtgggacacgccaagctcttcagtgaagacacgatgttattaaaagcct

SEQ ID NO: 3445 - DNA, 50 bp, Homo sapiens
tgctttgaagctacctggatatttcctatttgaaataaaattgttcggtc

SEQ ID NO: 3446 - DNA, 50 bp, Homo sapiens
atcgccaagaacctggttagaggcataaagaccttttttcaccgttacct

SEQ ID NO: 3447 - DNA, 50 bp, Homo sapiens
tgctgcgacgcacatacatacgtgttgtgtctgtcaataaagtgtaaata

SEQ ID NO: 3448 - DNA, 50 bp, Homo sapiens
tgggaggagataagaagagaaagggccaagtgatccagttctaagtgtca

SEQ ID NO: 3449 - DNA, 50 bp, Homo sapiens
tgcagtagttgactttgctgtatggaaaaataaagtgaaattgccctaat

SEQ ID NO: 3450 - DNA, 50 bp, Homo sapiens
gctaaataaggaatactcatgccaagatcatcgaattgtgcctcctccct

SEQ ID NO: 3451 - DNA, 50 bp, Homo sapiens; identical to SEQ ID NO: 1780

SEQ ID NO: 3452 - DNA, 50 bp, Homo sapiens
ggagtcagtcagtgctcctatatttttcattttttgtcaaagcaagaagt

SEQ ID NO: 3453 - DNA, 50 bp, Homo sapiens
tttgtggccgagtgtaacaaccatataataaatcacctcttccgctgttt

SEQ ID NO: 3454 - DNA, 50 bp, Homo sapiens
ttctacatgaaatgtttagctcttacactctatccttcctagaaaatggt

SEQ ID NO: 3455 - DNA, 50 bp, Homo sapiens
ggacgacagtgaaatctagagtaaaaccaagctggcccaagtgtcctgca

SEQ ID NO: 3456 - DNA, 50 bp, Homo sapiens
tgttttggggtctgtgagagtacatgtattatatacaagcacaacagggc

SEQ ID NO: 3457 - DNA, 50 bp, Homo sapiens
aggaacagttagttctcatctagaatgaaagttccatatatgcattggtg

SEQ ID NO: 3458 - DNA, 50 bp, Homo sapiens
tgtgtgtgtatcccataccccactctggaaggaaccatccagtaaaggtc

SEQ ID NO: 3459 - DNA, 50 bp, Homo sapiens
gtgcaaggggagcacatattggatgtatatgttaccatatgttaggaaat

SEQ ID NO: 3460 - DNA, 50 bp, Homo sapiens; identical to SEQ ID NO: 293

SEQ ID NO: 3461 - DNA, 50 bp, Homo sapiens
acccagtcacctctgtcttcagcaccctcataagtcgtcactaatacaca

SEQ ID NO: 3462 - DNA, 50 bp, Homo sapiens
tgaatcacattgtcagaattttttcctcctcgctgttcaattttgtagtt

SEQ ID NO: 3463 - DNA, 50 bp, Homo sapiens
agatgccttgttgctttgaagaagggagtgatgtcaattctcttgttaca

SEQ ID NO: 3464 - DNA, 50 bp, Homo sapiens; identical to SEQ ID NO: 649

SEQ ID NO: 3465 - DNA, 50 bp, Homo sapiens
aaaagttctctgtagatttctgaagtgcatattcattgatgccaagaaaa

SEQ ID NO: 3466 - DNA, 50 bp, Homo sapiens
ggaggagtttgcatgtctcatgataaccaaatgtaagatgaaaataaaag

SEQ ID NO: 3467 - DNA, 50 bp, Homo sapiens
ttggtgacttagtgattttgtcattttttacatcaacttcatggtcttgt

SEQ ID NO: 3468 - DNA, 50 bp, Homo sapiens
cgcccggcagcccccatccatctgtgtctgtctgttggcctgtatctgtt

SEQ ID NO: 3469 - DNA, 50 bp, Homo sapiens
ggcatcgccaacgcctgcctcgtgccacctcatgcttataataaagccgg

SEQ ID NO: 3470 - DNA, 50 bp, Homo sapiens; identical to SEQ ID NO: 3210

SEQ ID NO: 3471 - DNA, 50 bp, Homo sapiens
gccgtcctcagttacctttcatgaggcttctagccaaagatgataaaggg

SEQ ID NO: 3472 - DNA, 50 bp, Homo sapiens
aggataaaatcattgtctctggaggcaatttggaaattatttctgcttct

SEQ ID NO: 3473 - DNA, 50 bp, Homo sapiens
cgggtgattacaggcaccagtgcagtgatgattgtacttatttgacacat

SEQ ID NO: 3474 - DNA, 50 bp, Homo sapiens
gcctctggtgctttgtcctgtatttggtttaatgtttttgtcctaatctc

SEQ ID NO: 3475 - DNA, 50 bp, Homo sapiens
ttgatgtgaattcagttattgaacttgttacttgtttttgccagaaatgt

SEQ ID NO: 3476 - DNA, 50 bp, Homo sapiens
aagcttcgaactcaaaatcatggaaaggttttaagatttgaggttggttt

SEQ ID NO: 3477 - DNA, 50 bp, Homo sapiens
cccagttagatatcagtgagtttgaataactgaagaaatgttgacaatgt

SEQ ID NO: 3478 - DNA, 50 bp, Homo sapiens
aagtacacctgtcagctgtttcttaccacttcgatggttgtgattaattt

SEQ ID NO: 3479 - DNA, 50 bp, Homo sapiens
tgtttgcttgaacagttgtgtaaatcatacaggattttgtgggtattggt

SEQ ID NO: 3480 - DNA, 50 bp, Homo sapiens
tgaccttctgtgtttttgtttctgacttgaataatttatcaatggtgttg

SEQ ID NO: 3481 - DNA, 50 bp, Homo sapiens
ccagggctgctttgctgtgatgatgattgcatttcaacacatgccagatg

SEQ ID NO: 3482 - DNA, 50 bp, Homo sapiens
gagttaccacaccccatgagggaagctctaaatagccaacacccatctgt

SEQ ID NO: 3483 - DNA, 50 bp, Homo sapiens
ttctatccttgacttagattctggtggagagaagtgagaataggcagccc

SEQ ID NO: 3484 - DNA, 50 bp, Homo sapiens
tcttgctctttctactctgaactaataaagctgttgccaagctggacggc

SEQ ID NO: 3485 - DNA, 50 bp, Homo sapiens
tgcaaacaaatgcataaatgcaaatgtaaagtaaagctgaaattgatctc

SEQ ID NO: 3486 - DNA, 50 bp, Homo sapiens; identical to SEQ ID NO: 1727

SEQ ID NO: 3487 - DNA, 50 bp, Homo sapiens
tgcaatggaatataaatatcacaaagttgtttaactagactgcgtgttgt

SEQ ID NO: 3488 - DNA, 50 bp, Homo sapiens
tttcacctcctcagtcccttgcctaccccagtgagagtctgatcttgttt

SEQ ID NO: 3489 - DNA, 50 bp, Homo sapiens
cgcctctccccgtggaccctgttaatcccaataaaattctgagcaagttc

SEQ ID NO: 3490 - DNA, 50 bp, Homo sapiens
aggattcgctgttgaaacaagttgtccaagcaatgttatattcattttta

SEQ ID NO: 3491 - DNA, 50 bp, Homo sapiens
ggaagggggacaagggtcagtctgtcgggtgggggcagaaatcaaatcag

SEQ ID NO: 3492 - DNA, 50 bp, Homo sapiens; identical to SEQ ID NO: 3491

SEQ ID NO: 3493 - DNA, 50 bp, Homo sapiens
tttttcccagctcgccacagaatggatcatgaagactgacaactgcaaaa

SEQ ID NO: 3494 - DNA, 50 bp, Homo sapiens
aggagtggcctaagaaatgcgtgtttcagtgactagattataaatattct

SEQ ID NO: 3495 - DNA, 50 bp, Homo sapiens
agctgtgaacttcgtaactttgtaaagcaagatataaagcaaatacaaga

SEQ ID NO: 3496 - DNA, 50 bp, Homo sapiens
aggagggatcacctgcactgagaatgaggcagtttgacacagatcacaaa

SEQ ID NO: 3497 - DNA, 50 bp, Homo sapiens
tgttccactaccagccttacttgtttaataaaaatcagtgcaaagagaaa

SEQ ID NO: 3498 - DNA, 50 bp, Homo sapiens
acctcagattttgttacctgtcttttaaaaatgcagattttgtcaaatca

SEQ ID NO: 3499 - DNA, 50 bp, Homo sapiens
ttaacggcttcactggacagttttccttagaaggtagttttgtgtgactg

SEQ ID NO: 3500 - DNA, 50 bp, Homo sapiens
accgtgggtgtgtccaagaagaaataagtctgtaggccttgtctgttaat

SEQ ID NO: 3501 - DNA, 50 bp, Homo sapiens
ccaatggatatttctgtattactagggaggcatttacagtcctctaatgt

SEQ ID NO: 3502 - DNA, 50 bp, Homo sapiens
tagctttagaaaataacagtttgtgaacttacttccctatatttgcagct

SEQ ID NO: 3503 - DNA, 50 bp, Homo sapiens
ctttgtggactagccaaggctgtgagggccagaataaacaactgctcaac

SEQ ID NO: 3504 - DNA, 50 bp, Homo sapiens
gccgagcaatgacccttttcaatttcttatttctgtgttactgaggaccc

SEQ ID NO: 3505 - DNA, 50 bp, Homo sapiens
gaaacatgtggatttgctgtggaatgacaagcttcaaggatttacccagg

SEQ ID NO: 3506 - DNA, 50 bp, Homo sapiens
tttgatctgaaatgtttgagaagacacgaataaagttacttgggcagaaa

SEQ ID NO: 3507 - DNA, 50 bp, Homo sapiens
tcccatcaaaaaggtatcaaatgccttggaagctccctgatcctacaaaa

SEQ ID NO: 3508 - DNA, 50 bp, Homo sapiens
atctgacattattgtaactaccgtgtgatcagtaagattcctgtaagaaa

SEQ ID NO: 3509 - DNA, 50 bp, Homo sapiens
accttgtaccatggaaaacatgaaaagagtcttagaagtaaagaacaaca

SEQ ID NO: 3510 - DNA, 50 bp, Homo sapiens
agcatgtgtctgccatttcatttgtacgcttgttcaaaaccaagtttgtt

SEQ ID NO: 3511 - DNA, 50 bp, Homo sapiens
tgagctgtattaccataagtagaattttaagtaaactggtgaatttgggc

SEQ ID NO: 3512 - DNA, 50 bp, Homo sapiens
gccccattaaagggtgaacttgtaataaattggaatttcaaataaacctc

SEQ ID NO: 3513 - DNA, 50 bp, Homo sapiens; identical to SEQ ID NO: 991

SEQ ID NO: 3514 - DNA, 50 bp, Homo sapiens
aacgtcatgtgcacctttacactgtggttagtgtaataaaacatgttcct

SEQ ID NO: 3515 - DNA, 50 bp, Homo sapiens; identical to SEQ ID NO: 3369

SEQ ID NO: 3516 - DNA, 50 bp, Homo sapiens
gcagccacccactgggagtcttgtttttatttataataaaattgttgggg

SEQ ID NO: 3517 - DNA, 50 bp, Homo sapiens
atccaccaaaaattaggtcatcatagttgaggtatgtgtctgctatttgc

SEQ ID NO: 3518 - DNA, 50 bp, Homo sapiens
ccattggctggaacatggattggggatttgatagaaaaataaaccctgct

SEQ ID NO: 3519 - DNA, 50 bp, Homo sapiens
gttccttactctgtccttgatggaggggagaagggagggcaaagaagtta

SEQ ID NO: 3520 - DNA, 50 bp, Homo sapiens
tggttttcctttggggacgtggttaacggtccagaagaatcccttctaga

SEQ ID NO: 3521 - DNA, 50 bp, Homo sapiens
acccctttcactcttggctttcttatgttgctttcatgaatggaatggaa

SEQ ID NO: 3522 - DNA, 50 bp, Homo sapiens
cccatcctcatcccccacactgggatagatgcttgtttgtaaaaactcac

SEQ ID NO: 3523 - DNA, 50 bp, Homo sapiens
tcaggccgcctagctgcccctttgccaggttaataaagcactgacttgtt

SEQ ID NO: 3524 - DNA, 50 bp, Homo sapiens
aaggattttaaataactgccgacttcaaaagtgttcttaaaacgaaagat

SEQ ID NO: 3525 - DNA, 50 bp, Homo sapiens
cacccaccctccccccaatcagtgttcttatttcagtgacaataaaccat

SEQ ID NO: 3526 - DNA, 50 bp, Homo sapiens
atagctggtgacaaacagatggttgctcagggacaaggtgccttccaatg

SEQ ID NO: 3527 - DNA, 50 bp, Homo sapiens; identical to SEQ ID NO: 922

SEQ ID NO: 3528 - DNA, 50 bp, Homo sapiens; identical to SEQ ID NO: 1047

SEQ ID NO: 3529 - DNA, 50 bp, Homo sapiens; identical to SEQ ID NO: 1104

SEQ ID NO: 3530 - DNA, 50 bp, Homo sapiens
gctgctgtgtgtggtctcagaggctctgcttccttaggttacaaaacaaa

SEQ ID NO: 3531 - DNA, 50 bp, Homo sapiens; identical to SEQ ID NO: 817

SEQ ID NO: 3532 - DNA, 50 bp, Homo sapiens
ccccacaatggtctcttttctccctgctcccttattaaagaactctttct

SEQ ID NO: 3533 - DNA, 50 bp, Homo sapiens
cagtggttcccattgattctccccatatctttttgctctcaggctctggc

SEQ ID NO: 3534 - DNA, 50 bp, Homo sapiens
cttgtatctctaaatatggtgtgatatgaaccagtccattcacattggaa

SEQ ID NO: 3535 - DNA, 50 bp, Homo sapiens
acatagattttctgccaacaaatcctctctgctgttcacattatcctttg

SEQ ID NO: 3536 - DNA, 50 bp, Homo sapiens; identical to SEQ ID NO: 1484

SEQ ID NO: 3537 - DNA, 50 bp, Homo sapiens
ttagaaccaaagttattcttaataaaaatcaccacatgcttggaccatgc

SEQ ID NO: 3538 - DNA, 50 bp, Homo sapiens
gctcttacacttcgtctttaatgttctttttggagttaggacctctcagt

SEQ ID NO: 3539 - DNA, 50 bp, Homo sapiens
accttgacatgggttgtctaataaaactcggacccttcttgtgaaatcaa

SEQ ID NO: 3540 - DNA, 50 bp, Homo sapiens
atcccagtgcacagtgagttgtatatcacaaataggaggccacttcagga

SEQ ID NO: 3541 - DNA, 50 bp, Homo sapiens
gaagctgctaggggaaggactggcctggctccagaatgttgttgcctttt

SEQ ID NO: 3542 - DNA, 50 bp, Homo sapiens
gggaaggaaaaggggtgtggcagctgggagcgtttatttatgttctttct

SEQ ID NO: 3543 - DNA, 50 bp, Homo sapiens
gagtggtgttcccagtgtggctcccagagctttgaccagattgtgatccc

SEQ ID NO: 3544 - DNA, 50 bp, Homo sapiens
ctttgcatttagggacacagcccggagccgcagaaggtcagcagggagca

SEQ ID NO: 3545 - DNA, 50 bp, Homo sapiens
cattgcctactttaacacctgtcagagaaacgtgatatggggtaaggagg

SEQ ID NO: 3546 - DNA, 50 bp, Homo sapiens
gcaatctgggagcagcacattgttgatggagtccaagtgagcacatttca

SEQ ID NO: 3547 - DNA, 50 bp, Homo sapiens
ctctcctggactgttgcagttgggtgtggctgatttgaaattgtgcttca

SEQ ID NO: 3548 - DNA, 50 bp, Homo sapiens
taacaagaattgcattgaggaaacaaggctccacagggccaatcttctgg

SEQ ID NO: 3549 - DNA, 50 bp, Homo sapiens
aagaagttacatcttcaatgtccagggatgatcgtttgaagagaacctct

SEQ ID NO: 3550 - DNA, 50 bp, Homo sapiens
aaaacattgccagaccatttagtcctcttggaagggcctctccggtgggg

SEQ ID NO: 3551 - DNA, 50 bp, Homo sapiens
agggataataaggttagctgttaaccaagcaactgagcttttaaccaaag

SEQ ID NO: 3552 - DNA, 50 bp, Homo sapiens
caagacactgtggacttggtcaccagctcctcccttgttctctaagttcc

SEQ ID NO: 3553 - DNA, 50 bp, Homo sapiens
tctttgacggggttttccttgctcctgccaggattaaaagtccatgagtt

SEQ ID NO: 3554 - DNA, 50 bp, Homo sapiens
cttaaagtatatgttttcaaattgccattgctactattgcttgtcggtgt

SEQ ID NO: 3555 - DNA, 50 bp, Homo sapiens
ctcctgtcaccggccttgtgacattcactcagagaagaccacaccaagga

SEQ ID NO: 3556 - DNA, 50 bp, Homo sapiens
gtcggactatgtaattgtaactatacctctggttcccattaaaagtgacc

SEQ ID NO: 3557 - DNA, 50 bp, Homo sapiens
gctagtgtttgaatatgctctcttgttgctctaattctgtgcctccgtgc

SEQ ID NO: 3558 - DNA, 50 bp, Homo sapiens
agaggaacttgaaaccttgaaagacatttgttctcccaaaactgattact

SEQ ID NO: 3559 - DNA, 50 bp, Homo sapiens
actgggatattgcccacatgatcagtggctttgaatgaaatacagatgca

SEQ ID NO: 3560 - DNA, 50 bp, Homo sapiens; identical to SEQ ID NO: 2932

SEQ ID NO: 3561 - DNA, 50 bp, Homo sapiens
tttcttaggacaccatttgggctagtttctgtgtaagtgtaaatactaca

SEQ ID NO: 3562 - DNA, 50 bp, Homo sapiens; identical to SEQ ID NO: 2488

SEQ ID NO: 3563 - DNA, 50 bp, Homo sapiens
ttaacaccccacacccacccctcagttgggacaaataaaggattctcatg

SEQ ID NO: 3564 - DNA, 50 bp, Homo sapiens
caagccgccacatgcccacaacctcaccagagggagaattatgtttctaa

SEQ ID NO: 3565 - DNA, 50 bp, Homo sapiens
gtgtattgatccaagtagtcaaagtgtcttaaagggcacctatttgtcct

SEQ ID NO: 3566 - DNA, 50 bp, Homo sapiens
agtgctttccaaatgtgattgttctgggtgatgggacatatgggcagttg

SEQ ID NO: 3567 - DNA, 50 bp, Homo sapiens
cgggggaataggaggaaaaacatggcatggaacaaaccaacataaaaggt

SEQ ID NO: 3568 - DNA, 50 bp, Homo sapiens
actaattctgctctttggacaagtgcctgacatctgcttcattgggtttt

SEQ ID NO: 3569 - DNA, 50 bp, Homo sapiens
aggaataaagttaagtatttcccacttggaaattgtaccactcctggggt

SEQ ID NO: 3570 - DNA, 50 bp, Homo sapiens; identical to SEQ ID NO: 2144

SEQ ID NO: 3571 - DNA, 50 bp, Homo sapiens
gtctggtaagccgatgctaatggcagaagcaatagaagtccaaggcacta

SEQ ID NO: 3572 - DNA, 50 bp, Homo sapiens; identical to SEQ ID NO: 3416

SEQ ID NO: 3573 - DNA, 50 bp, Homo sapiens
ctctcagttcccaagatggccccacattcccattgttttccccaagagaa

SEQ ID NO: 3574 - DNA, 50 bp, Homo sapiens
ggttgttgtattgtaccagtgaaatgccaaatttgaaaggcctgtactgc

SEQ ID NO: 3575 - DNA, 50 bp, Homo sapiens
ttgtttgccatctgttgatcaggaactacttcagctacttgcatttgatt

SEQ ID NO: 3576 - DNA, 50 bp, Homo sapiens; identical to SEQ ID NO: 2966

SEQ ID NO: 3577 - DNA, 50 bp, Homo sapiens
acagagagcacccaggaggtacacatactaaagtgacacaaagagaatga

SEQ ID NO: 3578 - DNA, 50 bp, Homo sapiens; identical to SEQ ID NO: 1887

SEQ ID NO: 3579 - DNA, 50 bp, Homo sapiens
agcatgttgtttaatttctttttaaaaatcactgttgggctttgaaagca

SEQ ID NO: 3580 - DNA, 50 bp, Homo sapiens
gctgacaaaacctgggaatttgggttgtgtatgcgaatgtttcagtgcct

SEQ ID NO: 3581 - DNA, 50 bp, Homo sapiens
tcactttccaaatgcctgttttgtgctttacaataaatgatatgaaacct

SEQ ID NO: 3582 - DNA, 50 bp, Homo sapiens
tttatgcgtatttaagccttggaaacacagggactatcttgtggattggg

SEQ ID NO: 3583 - DNA, 50 bp, Homo sapiens; identical to SEQ ID NO: 2782

SEQ ID NO: 3584 - DNA, 50 bp, Homo sapiens
acatccagtgtctccaaaattgtttccttgtactgatataaacacttcca

SEQ ID NO: 3585 - DNA, 50 bp, Homo sapiens
ggtacagttggagcactatatgtactctctggactactttggacagaagt

SEQ ID NO: 3586 - DNA, 50 bp, Homo sapiens
aaaatcacctcaacagccctgtgaagtgacctcagtgagatatttggatc

SEQ ID NO: 3587 - DNA, 50 bp, Homo sapiens
ttaaagtgcaccttccaaaatgtctcccataagtaggtaagaccaacctg

SEQ ID NO: 3588 - DNA, 50 bp, Homo sapiens
aatgatgagtgtgtggctacatacaaaggagttccctttgaggtgaaagg

SEQ ID NO: 3589 - DNA, 50 bp, Homo sapiens; identical to SEQ ID NO: 2872

SEQ ID NO: 3590 - DNA, 50 bp, Homo sapiens; identical to SEQ ID NO: 2749

SEQ ID NO: 3591 - DNA, 50 bp, Homo sapiens
ttgtccacaagtaaaaggaaatcctcctccagggagtctcagcttcaccc

SEQ ID NO: 3592 - DNA, 50 bp, Homo sapiens
cattgctctttagtgtgtgttaacctgtggtttgaaagaaatgctcttgt

SEQ ID NO: 3593 - DNA, 50 bp, Homo sapiens
gtctggcttaactatttttgaaaatataactgtttcccctctctgctgct

SEQ ID NO: 3594 - DNA, 50 bp, Homo sapiens
aaaagcaattacccttaaaactgtactctggcctacttttctattttgca

SEQ ID NO: 3595 - DNA, 50 bp, Homo sapiens
ggctctcagtgtgccatagaggacagcaactggtgattgtttcagagaaa

SEQ ID NO: 3596 - DNA, 50 bp, Homo sapiens
aaactgtttctttggtgtcctttacattgaaataaattgtgtttgtgcct

SEQ ID NO: 3597 - DNA, 50 bp, Homo sapiens; identical to SEQ ID NO: 2640

SEQ ID NO: 3598 - DNA, 50 bp, Homo sapiens
agagagggaacatcaaatgctggcactatatacatacgatcagcctgatt

SEQ ID NO: 3599 - DNA, 50 bp, Homo sapiens
gtcttccgagaaacttttctgatcagtttgcgagttttgatgagttttgt

SEQ ID NO: 3600 - DNA, 50 bp, Homo sapiens
gctgctgttgctgctttgtgatgacgtgagatcaataagaagaacctagt

SEQ ID NO: 3601 - DNA, 50 bp, Homo sapiens
aggactgaactgaacccctccccatgaacacaagggttttatcctttcct

SEQ ID NO: 3602 - DNA, 50 bp, Homo sapiens
gatgtggtaactgttaaattgctgtgtatctgatagctctttggcagtct

SEQ ID NO: 3603 - DNA, 50 bp, Homo sapiens
gatcaaaagggctatgggaagggcagaccccgccaatgatttctcttcac

SEQ ID NO: 3604 - DNA, 50 bp, Homo sapiens
gaacagctttgtgctccggctttccctcagggaacagcagagagcagttg

SEQ ID NO: 3605 - DNA, 50 bp, Homo sapiens
tccagggaccaacattaacacaaccaatcaacacatcatgttacagaact

SEQ ID NO: 3606 - DNA, 50 bp, Homo sapiens
tattaaaggcttttggcagcaaagtgtcagtgttggcagcgaagtgtcag

SEQ ID NO: 3607 - DNA, 50 bp, Homo sapiens
ttcacaagatgctttgaaggttctgattttcaactgatcaaactaatgca

SEQ ID NO: 3608 - DNA, 50 bp, Homo sapiens; identical to SEQ ID NO: 1944

SEQ ID NO: 3609 - DNA, 50 bp, Homo sapiens; identical to SEQ ID NO: 2738

SEQ ID NO: 3610 - DNA, 50 bp, Homo sapiens
ctgtgtctggcaccacccacacatccatgtctccctcacaacccaggagg

SEQ ID NO: 3611 - DNA, 50 bp, Homo sapiens
catgtatgtaggtgcctgggagtgtgtgtggtccttgctctggccctttc

SEQ ID NO: 3612 - DNA, 50 bp, Homo sapiens; identical to SEQ ID NO: 2263

SEQ ID NO: 3613 - DNA, 50 bp, Homo sapiens
tcttcggaaagaagaaggtgggaggatgtgaattgttagtttctgagttt

SEQ ID NO: 3614 - DNA, 50 bp, Homo sapiens
atcaagcctctgtgcctcagtttctctctcaggataaagagtgaatagag

SEQ ID NO: 3615 - DNA, 50 bp, Homo sapiens
gcgatagaggaaatctactccctatcttgggtccttgaactacagcctgc

SEQ ID NO: 3616 - DNA, 50 bp, Homo sapiens
ctagggagccgcaccttgtcatgtaccatcaataaagtaccctgtgctca

SEQ ID NO: 3617 - DNA, 50 bp, Homo sapiens
tttctccccctagtttgtgagaaacatctcaataaagtgctttccaaaaa

SEQ ID NO: 3618 - DNA, 50 bp, Homo sapiens; identical to SEQ ID NO: 3507

SEQ ID NO: 3619 - DNA, 50 bp, Homo sapiens
tgccaaaagtttgccatgtgccttaaacatattactatatattttcccct

SEQ ID NO: 3620 - DNA, 50 bp, Homo sapiens; identical to SEQ ID NO: 2975

SEQ ID NO: 3621 - DNA, 50 bp, Homo sapiens
ttaccaagaaggacttaagggagtaaggggcgcagattagcattgctcaa

SEQ ID NO: 3622 - DNA, 50 bp, Homo sapiens
gatatgcacatcaaagcctttaccagtatcttcctgtattccgtatcaga

SEQ ID NO: 3623 - DNA, 50 bp, Homo sapiens
ctctgaggcgtgaggactcgcagtcaggggcagctgaccatggaagattg

SEQ ID NO: 3624 - DNA, 50 bp, Homo sapiens
cctctcttcctccctggaatcttgtaaaggtcctggcaaagatgatcagt

SEQ ID NO: 3625 - DNA, 50 bp, Homo sapiens
gcctcctggtctcttcaccactgtagttctctcatttccaaaccatcagc

SEQ ID NO: 3626 - DNA, 50 bp, Homo sapiens
ttttccttctaacacttgtatttggaggctcttctgtgattttgagaagt

SEQ ID NO: 3627 - DNA, 50 bp, Homo sapiens; identical to SEQ ID NO: 2578

SEQ ID NO: 3628 - DNA, 50 bp, Homo sapiens
ggacatccactagagatgggtttgaggattttccaagcgtgtaataatga

SEQ ID NO: 3629 - DNA, 50 bp, Homo sapiens
ttgcacgcagagcctttaagtgactaaggaacaacatagatagtgagcat

SEQ ID NO: 3630 - DNA, 50 bp, Homo sapiens
actttaatctgatcttgtgtcttagagaagcccccatacctggtagagca

SEQ ID NO: 3631 - DNA, 50 bp, Homo sapiens
tgtaggaaaggatgcttcacaaactgaggtagataatgctatgctgtcgt

SEQ ID NO: 3632 - DNA, 50 bp, Homo sapiens; identical to SEQ ID NO: 3631

SEQ ID NO: 3633 - DNA, 50 bp, Homo sapiens
ctggggagaggctgaggacaaatacctgctgtcactccagaggacatttt

SEQ ID NO: 3634 - DNA, 50 bp, Homo sapiens
cattacttgtgagctgctgaacaaacaagtcaaggtgagcccggacatgg

SEQ ID NO: 3635 - DNA, 50 bp, Homo sapiens; identical to SEQ ID NO: 2547

SEQ ID NO: 3636 - DNA, 50 bp, Homo sapiens
gaaacttgctacagacttacccgtaatatttgtcaagatcatagctgact

SEQ ID NO: 3637 - DNA, 50 bp, Homo sapiens; identical to SEQ ID NO: 47

SEQ ID NO: 3638 - DNA, 50 bp, Homo sapiens
tgctaaatatgttattgtggaaagatgaatgcaatagtaggactgctgac

SEQ ID NO: 3639 - DNA, 50 bp, Homo sapiens; identical to SEQ ID NO: 2914

SEQ ID NO: 3640 - DNA, 50 bp, Homo sapiens
tcctcttttctttcaagaactatatataaatgacctgttttcacgcggcc

SEQ ID NO: 3641 - DNA, 50 bp, Homo sapiens
agctgcaaagtgttttgtaccagtgaatttttgcaataatgcagtatggt

SEQ ID NO: 3642 - DNA, 50 bp, Homo sapiens; identical to SEQ ID NO: 2661

SEQ ID NO: 3643 - DNA, 50 bp, Homo sapiens
acatagtgaaagtttataagaggatgaagtgatatggtgagcagcggact

SEQ ID NO: 3644 - DNA, 50 bp, Homo sapiens
aacagcctttctggctgaccacatggttaaatgcataccttcccagtact

SEQ ID NO: 3645 - DNA, 50 bp, Homo sapiens
tgtgcctcacctggacttgtccaattaatgaagttgattcatattgcatc

SEQ ID NO: 3646 - DNA, 50 bp, Homo sapiens
ctatagatgaagacataaaagacactggtaaacaccaatgtaaaagggcc

SEQ ID NO: 3647 - DNA, 50 bp, Homo sapiens; identical to SEQ ID NO: 2915

SEQ ID NO: 3648 - DNA, 50 bp, Homo sapiens; identical to SEQ ID NO: 2750

SEQ ID NO: 3649 - DNA, 50 bp, Homo sapiens
gattcttgctgtagcgtggatagctgtgattggtgagtcaaccgtctgtg

SEQ ID NO: 3650 - DNA, 50 bp, Homo sapiens
tgggcattttaaagccatctcaagaggcatcttctacatgttttgtacgc

SEQ ID NO: 3651 - DNA, 50 bp, Homo sapiens
aagtcagggaccacttgctgaagcacgaagagcccttgtggcaatgttaa

SEQ ID NO: 3652 - DNA, 50 bp, Homo sapiens
gactgctggaagatgatctttctgcactgagactgtggagtttggggaag

SEQ ID NO: 3653 - DNA, 50 bp, Homo sapiens; identical to SEQ ID NO: 2117

SEQ ID NO: 3654 - DNA, 50 bp, Homo sapiens
aattccagctgagcgccggtcgctaccattaccgttggtcttggtgtcaa

SEQ ID NO: 3655 - DNA, 50 bp, Homo sapiens
ccccaaccctcaaattaaaactagaactatagatccacatgaacgcacgc

SEQ ID NO: 3656 - DNA, 50 bp, Homo sapiens
agcttttgaaataaaatttaaaaaccccaagcctgggtgagtgtgggaaa

SEQ ID NO: 3657 - DNA, 50 bp, Homo sapiens; identical to SEQ ID NO: 2700

SEQ ID NO: 3658 - DNA, 50 bp, Homo sapiens; identical to SEQ ID NO: 2844

SEQ ID NO: 3659 - DNA, 50 bp, Homo sapiens; identical to SEQ ID NO: 2981

SEQ ID NO: 3660 - DNA, 50 bp, Homo sapiens; identical to SEQ ID NO: 2511

SEQ ID NO: 3661 - DNA, 50 bp, Homo sapiens
gaattttcagtttgtgcttacattttctaacattggatgtttgctttggc

SEQ ID NO: 3662 - DNA, 50 bp, Homo sapiens
tatgactttaagagcccacattaggttttatgattcatttgccaggtttt

SEQ ID NO: 3663 - DNA, 50 bp, Homo sapiens
ggcgtgccgttgagggggaaaacgaagcccagtatttgctactgtttttc

SEQ ID NO: 3664 - DNA, 50 bp, Homo sapiens
ctcttgggcataaaatctcagaggaagctacttaggacatcatcttggcc

SEQ ID NO: 3665 - DNA, 50 bp, Homo sapiens
tctacagtagcctgtgctgaactgatctcttaaataaacttgcttctggt

SEQ ID NO: 3666 - DNA, 50 bp, Homo sapiens
ttctcaagtttgatactgagttgactgttcccttatccctcaccgttccc

SEQ ID NO: 3667 - DNA, 50 bp, Homo sapiens
agacttttccaaccctcatcaccaacgtctgtgccattttgtattttact

SEQ ID NO: 3668 - DNA, 50 bp, Homo sapiens
ccagcggcatctttccttgtcgaatgatactgtaatgaccttccaaagtg

SEQ ID NO: 3669 - DNA, 50 bp, Homo sapiens; identical to SEQ ID NO: 163

SEQ ID NO: 3670 - DNA, 50 bp, Homo sapiens
tgtgggttgagaccagcactctgtgaaaccttgaaatgagaagtaaaggc

SEQ ID NO: 3671 - DNA, 50 bp, Homo sapiens
tgaatacaaagaaccaagaaaaaggaatgaagactcgcaatttcacgaca

SEQ ID NO: 3672 - DNA, 50 bp, Homo sapiens
ctgaatttggttttgggaggtgaggcttcccaaccacggaagactacttt

SEQ ID NO: 3673 - DNA, 50 bp, Homo sapiens; identical to SEQ ID NO: 3039

SEQ ID NO: 3674 - DNA, 50 bp, Homo sapiens
gacgccttacaaatgatggaggattccaaagagtttttgtttatttgggt

SEQ ID NO: 3675 - DNA, 50 bp, Homo sapiens; identical to SEQ ID NO: 2992

SEQ ID NO: 3676 - DNA, 50 bp, Homo sapiens; identical to SEQ ID NO: 123

SEQ ID NO: 3677 - DNA, 50 bp, Homo sapiens
cagctctgggaaatagaagactagggttgtttcttaaatttagctcatgt

SEQ ID NO: 3678 - DNA, 50 bp, Homo sapiens
tgacttatgagctgtgactcaactgcttcattaaacattctgcattgggt

SEQ ID NO: 3679 - DNA, 50 bp, Homo sapiens
acactgagatagtcagttgtgtgtgactctaataaacggagcctaccttt

SEQ ID NO: 3680 - DNA, 50 bp, Homo sapiens; identical to SEQ ID NO: 3153

SEQ ID NO: 3681 - DNA, 50 bp, Homo sapiens
ggatgataacaccctatgcccattgtcctgatctgaaaattcttggaaat

SEQ ID NO: 3682 - DNA, 50 bp, Homo sapiens; identical to SEQ ID NO: 117

SEQ ID NO: 3683 - DNA, 50 bp, Homo sapiens
aaaagcatttaagttgaatgcgaccaaccttgtgctcttttcattctgga

SEQ ID NO: 3684 - DNA, 50 bp, Homo sapiens
ccttgagaaacacccatctccactcctagacaaaccaatgaacattagtc

SEQ ID NO: 3685 - DNA, 50 bp, Homo sapiens
tcttaaggtgtggcagagacagggtatttgggatatacttttcagactcc

SEQ ID NO: 3686 - DNA, 50 bp, Homo sapiens
aacaataaaatatggctagactggcctctggttgcctaaacagagcatca

SEQ ID NO: 3687 - DNA, 50 bp, Homo sapiens
cttaactgagggcttgtcctggttataaatgtctgggtgggggtgggcac

SEQ ID NO: 3688 - DNA, 50 bp, Homo sapiens
aactgtgaggcaaataaaatgcttctcaaactgtgtggctcttatggggt

SEQ ID NO: 3689 - DNA, 50 bp, Homo sapiens
gtggctaagtcattgcaggaacggggctgtgttctctgctgggacaaaac

SEQ ID NO: 3690 - DNA, 50 bp, Homo sapiens
attgcgactgtatggagaagaactgtttgtcattcagtgccgtgggatat

SEQ ID NO: 3691 - DNA, 50 bp, Homo sapiens
tttatagaacaattcctttctcttctcttgaatgtggcagtcattactgc

SEQ ID NO: 3692 - DNA, 50 bp, Homo sapiens
ttgattagagcaatgggaagcatactgtggcctaccagcatctggaagtg

SEQ ID NO: 3693 - DNA, 50 bp, Homo sapiens
tcaattgaggccccttccctaagattacaacattgataacctgtcctttt

SEQ ID NO: 3694 - DNA, 50 bp, Homo sapiens
cagccctccgtcgctttttataaaactttgtgtgagaagaatatattgat

SEQ ID NO: 3695 - DNA, 50 bp, Homo sapiens
acttcagatccttttgtgtttaaataaaggaaaagctgcacatccaaaaa

SEQ ID NO: 3696 - DNA, 50 bp, Homo sapiens
agcctacctcctaccccagctgtctgttgagagcagtgctgaccccagca

SEQ ID NO: 3697 - DNA, 50 bp, Homo sapiens
gaagagctgctctcacctctctgcatcccaatagatatccccctatgtgc

SEQ ID NO: 3698 - DNA, 50 bp, Homo sapiens; identical to SEQ ID NO: 1921

SEQ ID NO: 3699 - DNA, 50 bp, Homo sapiens
aaatacaaacattctaattaaaggctttgcaacacatgccttgtctgttt

SEQ ID NO: 3700 - DNA, 50 bp, Homo sapiens
gccattaccaactgtaccttcccttcttgctcagccaataaatatatcct

SEQ ID NO: 3701 - DNA, 50 bp, Homo sapiens; identical to SEQ ID NO: 1986

SEQ ID NO: 3702 - DNA, 50 bp, Homo sapiens; identical to SEQ ID NO: 1875

SEQ ID NO: 3703 - DNA, 50 bp, Homo sapiens
ctggggaggaggtccagggaggaggaggaaagttctcaagttcgtctgac

SEQ ID NO: 3704 - DNA, 50 bp, Homo sapiens
aactaacagtcacgccgtgggatgtctctgtccacattaaactaacagca

SEQ ID NO: 3705 - DNA, 50 bp, Homo sapiens; identical to SEQ ID NO: 2151

SEQ ID NO: 3706 - DNA, 50 bp, Homo sapiens
tttgtctatattctgctcccagcctgccaggccaggaggaaataaacatg

SEQ ID NO: 3707 - DNA, 50 bp, Homo sapiens
ttcctctttggccacaagaataagcagcaaataaacaactatggctgttg

SEQ ID NO: 3708 - DNA, 50 bp, Homo sapiens; identical to SEQ ID NO: 3126

SEQ ID NO: 3709 - DNA, 50 bp, Homo sapiens
gcagtttgaatatcctttgtttcagagccagatcatttcttggaaagtgt

SEQ ID NO: 3710 - DNA, 50 bp, Homo sapiens
ccctggttgacttgactcatgcttgtttcactttcacatggaatttccca

SEQ ID NO: 3711 - DNA, 50 bp, Homo sapiens; identical to SEQ ID NO: 2005

SEQ ID NO: 3712 - DNA, 50 bp, Homo sapiens
cacaaggtaaagaaactcaattcccctgcttggagcccagcaaacacaat

SEQ ID NO: 3713 - DNA, 50 bp, Homo sapiens
tgtggaggaaactaaacattcccttgatggtctcaagctatgatcagaag

SEQ ID NO: 3714 - DNA, 50 bp, Homo sapiens
ggaggagaccagtcccccacccagccgtaccagaaataaaggcttctgtg

SEQ ID NO: 3715 - DNA, 50 bp, Homo sapiens; identical to SEQ ID NO: 243

SEQ ID NO: 3716 - DNA, 50 bp, Homo sapiens
cgctgttaggccggaattaaagtggctttttgaggtttggtttttcacaa

SEQ ID NO: 3717 - DNA, 50 bp, Homo sapiens
ggggtttatgtcctaactgctttgtatgctgttttataaagggatagaag

SEQ ID NO: 3718 - DNA, 50 bp, Homo sapiens
acaccaacctgcttccactttattcttgtttacacattctcctgctccca

SEQ ID NO: 3719 - DNA, 50 bp, Homo sapiens
aagatgtttgtggaaatgttcatttgtatctggatctctgttatgtgcca

SEQ ID NO: 3720 - DNA, 50 bp, Homo sapiens; identical to SEQ ID NO: 3482

SEQ ID NO: 3721 - DNA, 50 bp, Homo sapiens; identical to SEQ ID NO: 2348

SEQ ID NO: 3722 - DNA, 50 bp, Homo sapiens; identical to SEQ ID NO: 1983

SEQ ID NO: 3723 - DNA, 50 bp, Homo sapiens
tcgaatcattgaagatccgagtgtgatttgaattctgtgatattttcaca

SEQ ID NO: 3724 - DNA, 50 bp, Homo sapiens
atatccaatattcgctgtgtcagcatagaagtaacttacttaggtgtggg

SEQ ID NO: 3725 - DNA, 50 bp, Homo sapiens; identical to SEQ ID NO: 1980

SEQ ID NO: 3726 - DNA, 50 bp, Homo sapiens; identical to SEQ ID NO: 2712

SEQ ID NO: 3727 - DNA, 50 bp, Homo sapiens
tctccatgttgtcaaaatcatgccgtttatagctattttcacctcagtgg

SEQ ID NO: 3728 - DNA, 50 bp, Homo sapiens
gccccgttttggggacgtgaacgttttaataatttttgctgaattcttta

SEQ ID NO: 3729 - DNA, 50 bp, Homo sapiens
aggtgggcacaagtattacacatcagaaaatcctgacaaaagggacacat

SEQ ID NO: 3730 - DNA, 50 bp, Homo sapiens
gttcaacaacaccagaactgtgtgtctcatggtatgtaactcttaaagca

SEQ ID NO: 3731 - DNA, 50 bp, Homo sapiens; identical to SEQ ID NO: 2480

SEQ ID NO: 3732 - DNA, 50 bp, Homo sapiens
aaagctgttcaaatactcgagcccagtcttgtggatggaaatgtagtgct

SEQ ID NO: 3733 - DNA, 50 bp, Homo sapiens
cttaagtctgacggacctgtcctgtccaggccagtgcccagggaaggtgt

SEQ ID NO: 3734 - DNA, 50 bp, Homo sapiens
tttctaaccctgacacggactgtgcatactttccctcatccatgctgtgc

SEQ ID NO: 3735 - DNA, 50 bp, Homo sapiens
cagcagctgcctgcttttctgtgatgtatgtatcctgttgacttttccag

SEQ ID NO: 3736 - DNA, 50 bp, Homo sapiens; identical to SEQ ID NO: 2756

SEQ ID NO: 3737 - DNA, 50 bp, Homo sapiens; identical to SEQ ID NO: 113

SEQ ID NO: 3738 - DNA, 50 bp, Homo sapiens
acccatttctactttttgcaccttattttctctgttcctgagcccccaca

SEQ ID NO: 3739 - DNA, 50 bp, Homo sapiens; identical to SEQ ID NO: 2362

SEQ ID NO: 3740 - DNA, 50 bp, Homo sapiens
ggcccagcattgctggttctatttaatggacatgagataatgttagaggt

SEQ ID NO: 3741 - DNA, 50 bp, Homo sapiens
tgaatataatatatttgtgtatttaacagggaggggaagagggggcgatc

SEQ ID NO: 3742 - DNA, 50 bp, Homo sapiens
tggcactttaacattgctttcacctatattttgtgtactttgttacttgc

SEQ ID NO: 3743 - DNA, 50 bp, Homo sapiens
agtaaatgtacagtgatttgaaatacaataatgaaggcaatgcatggcct

SEQ ID NO: 3744 - DNA, 50 bp, Homo sapiens
cttaatgtgacctagcaataggcatagctacgtggcactatattctggcc

SEQ ID NO: 3745 - DNA, 50 bp, Homo sapiens
aggagcacctcacagatgccaacctcaacctgaccgtggacgagggtgtc

SEQ ID NO: 3746 - DNA, 50 bp, Homo sapiens
ccacgacttctgcccattctctccagtgtgtgtaacagggtcacaagaat

SEQ ID NO: 3747 - DNA, 50 bp, Homo sapiens
ggcccaaacctatttgtaaccaaagagctgggagcagcacaaggacccag

SEQ ID NO: 3748 - DNA, 50 bp, Homo sapiens
gcgagcaagcattttgaacacatggatttccttgaagcaggctgacaaga

SEQ ID NO: 3749 - DNA, 50 bp, Homo sapiens
tcggatgggctgtttagatgttatataatccacaaaaggttcattgagct

SEQ ID NO: 3750 - DNA, 50 bp, Homo sapiens; identical to SEQ ID NO: 2285

SEQ ID NO: 3751 - DNA, 50 bp, Homo sapiens
aaaatgaagtcacacaggacaattattcttatgcctaagttaacagtgga

SEQ ID NO: 3752 - DNA, 50 bp, Homo sapiens
gccttgtttaatggtagttttacagtgtttctggcttagaacaaaggggc

SEQ ID NO: 3753 - DNA, 50 bp, Homo sapiens; identical to SEQ ID NO: 3034

SEQ ID NO: 3754 - DNA, 50 bp, Homo sapiens; identical to SEQ ID NO: 2199

SEQ ID NO: 3755 - DNA, 50 bp, Homo sapiens; identical to SEQ ID NO: 3388

SEQ ID NO: 3756 - DNA, 50 bp, Homo sapiens
tggtataagaaatgactttgaaccactttgcaattgtagattcccaacaa

SEQ ID NO: 3757 - DNA, 50 bp, Homo sapiens
cccctgctactttgaaaccagaaaataatgactggccattcgttacatct

SEQ ID NO: 3758 - DNA, 50 bp, Homo sapiens; identical to SEQ ID NO: 2508

SEQ ID NO: 3759 - DNA, 50 bp, Homo sapiens
aaaagccttgtgaaaatgttatgccctatgtaacagcagagtaacataaa

SEQ ID NO: 3760 - DNA, 50 bp, Homo sapiens
ccaccacgggagactagagctgcaggatcccgggggaggggtctctcctc

SEQ ID NO: 3761 - DNA, 50 bp, Homo sapiens
cagtggaagtcccacagaagctacagctgccaggtcacgcatgaagggag

SEQ ID NO: 3762 - DNA, 50 bp, Homo sapiens
cccacactgctttgctgtgtatacgcttgttgccctgaaataaatatgca

SEQ ID NO: 3763 - DNA, 50 bp, Homo sapiens; identical to SEQ ID NO: 3762

SEQ ID NO: 3764 - DNA, 50 bp, Homo sapiens; identical to SEQ ID NO: 1425

SEQ ID NO: 3765 - DNA, 50 bp, Homo sapiens
agagaccagttttctctggaagtttgtttaaatgacagaagcgtatatga

SEQ ID NO: 3766 - DNA, 50 bp, Homo sapiens
cgcccctgccacctccctgacccgtctaatatataaatatagagatgtgt

SEQ ID NO: 3767 - DNA, 50 bp, Homo sapiens
gccagtcagatgtttctcatccttcttgctctgcctttgagttgttccgt

SEQ ID NO: 3768 - DNA, 50 bp, Homo sapiens
aaatactgatgttcctagtgaaagaggcagcttgaaactgagatgtgaac

SEQ ID NO: 3769 - DNA, 50 bp, Homo sapiens
agaagctgcactaggccccgagtccccatgtgtctccttgaattgatgag

SEQ ID NO: 3770 - DNA, 50 bp, Homo sapiens; identical to SEQ ID NO: 2177

SEQ ID NO: 3771 - DNA, 50 bp, Homo sapiens
aaattttatttccagctcctgttccttggaaaatctccattgtatgtgca

SEQ ID NO: 3772 - DNA, 50 bp, Homo sapiens
cctgaaacagctgccaccatcactcgcaagagaatcccctccatctttgg

SEQ ID NO: 3773 - DNA, 50 bp, Homo sapiens
ttctgtgtgtatggtagcacagcaaacttgtaggaattagtatcaatagt

SEQ ID NO: 3774 - DNA, 50 bp, Homo sapiens; identical to SEQ ID NO: 2106

SEQ ID NO: 3775 - DNA, 50 bp, Homo sapiens
gatctcctcttagggtagaagaagtctctgggacatccctggggtgtgtg

SEQ ID NO: 3776 - DNA, 50 bp, Homo sapiens
ggctgccgcaataaaacccagatttctttggtgcgaatgccttacgcatg

SEQ ID NO: 3777 - DNA, 50 bp, Homo sapiens
tcatcatctggatttaggaattgctcttgtcatacccccaagtttctaag

SEQ ID NO: 3778 - DNA, 50 bp, Homo sapiens
tgcccaccactgaaagagtgactttgacaagatgtttctacctcttccca

SEQ ID NO: 3779 - DNA, 50 bp, Homo sapiens
tttgatcaggattcagatgtggacatcttcccctcagacttccctactga

SEQ ID NO: 3780 - DNA, 50 bp, Homo sapiens; identical to SEQ ID NO: 180

SEQ ID NO: 3781 - DNA, 50 bp, Homo sapiens
cggattgttgctgttaatgctgctcattttagcactgtggaagattggat

SEQ ID NO: 3782 - DNA, 50 bp, Homo sapiens
tagagattgtgaagaagaatttcgatctccgccctggggtcattgtcagg

SEQ ID NO: 3783 - DNA, 50 bp, Homo sapiens; identical to SEQ ID NO: 2036

SEQ ID NO: 3784 - DNA, 50 bp, Homo sapiens; identical to SEQ ID NO: 2461

SEQ ID NO: 3785 - DNA, 50 bp, Homo sapiens
ggaagaaccgtccagagctgagtgacgctgggatccgggatcaaagttgg

SEQ ID NO: 3786 - DNA, 50 bp, Homo sapiens
tgtgcattgttattgagttgtactgtaccttatttggaaggatgaaggaa

SEQ ID NO: 3787 - DNA, 50 bp, Homo sapiens; identical to SEQ ID NO: 2727

SEQ ID NO: 3788 - DNA, 50 bp, Homo sapiens
agaagcatgtcactttcatgttcctccctaactccctgacctgagaaccc

SEQ ID NO: 3789 - DNA, 50 bp, Homo sapiens
ggatgctcctcccttctctacctcatgggggtattgtataagtccttgca

SEQ ID NO: 3790 - DNA, 50 bp, Homo sapiens
gcaccatctgtcttcatcttccgccatctgatgagcagttgaaatctgga

SEQ ID NO: 3791 - DNA, 50 bp, Homo sapiens; identical to SEQ ID NO: 3790

SEQ ID NO: 3792 - DNA, 50 bp, Homo sapiens; identical to SEQ ID NO: 2358

SEQ ID NO: 3793 - DNA, 50 bp, Homo sapiens
ggcctgttactctccatgactaactgtgtaagtgcttaaaatggaataaa

SEQ ID NO: 3794 - DNA, 50 bp, Homo sapiens; identical to SEQ ID NO: 2847

SEQ ID NO: 3795 - DNA, 50 bp, Homo sapiens
tcttgataccacctatatagatgcagcattttgtatttgtctaactgggg

SEQ ID NO: 3796 - DNA, 50 bp, Homo sapiens; identical to SEQ ID NO: 2443

SEQ ID NO: 3797 - DNA, 50 bp, Homo sapiens; identical to SEQ ID NO: 2477

SEQ ID NO: 3798 - DNA, 50 bp, Homo sapiens
ttgaggggattaatatgaaaacttatgacctcttcctttaggagggagtt

SEQ ID NO: 3799 - DNA, 50 bp, Homo sapiens
tgttaaaacccctatagccaccttttgggaatgttttaaattctccagtt

SEQ ID NO: 3800 - DNA, 50 bp, Homo sapiens
tggcaggcgtcaaccccattttatttgtccttattcctgtggaagcagta

SEQ ID NO: 3801 - DNA, 50 bp, Homo sapiens
aatacacctgcttcacgtccctatgttgggaagtccatatttgtctgctt

SEQ ID NO: 3802 - DNA, 50 bp, Homo sapiens
caggaaatgcagcaacttcaggaaatgcagcaacaaaaatacctactcct

SEQ ID NO: 3803 - DNA, 50 bp, Homo sapiens
aaacccagttgccatctgcgtgacaataaaacattaatgctaacactttt

SEQ ID NO: 3804 - DNA, 50 bp, Homo sapiens
tgctgtattacttctgaaaagactgtgcagtgtgttagttgttggctgaa

SEQ ID NO: 3805 - DNA, 50 bp, Homo sapiens
gtgtatgagagagagagtgtgtgtttgtgtgtttcaaggtcagaacaggt

SEQ ID NO: 3806 - DNA, 50 bp, Homo sapiens; identical to SEQ ID NO: 2025

SEQ ID NO: 3807 - DNA, 50 bp, Homo sapiens
tgtccccttccccaccctctagtgtatttcacagaaaacaaaacctccca

SEQ ID NO: 3808 - DNA, 50 bp, Homo sapiens
agtccagttttatgattctgcttttatgtgtcccttgataacagtgactt

SEQ ID NO: 3809 - DNA, 50 bp, Homo sapiens
aaactcatctgtccaagttcgtggcagaaaggaacgtccttgtgaagacc

SEQ ID NO: 3810 - DNA, 50 bp, Homo sapiens
agagcactgggtagccaagtgatcttcccattcacagagttagtaaacct

SEQ ID NO: 3811 - DNA, 50 bp, Homo sapiens
cccccagagaccccatttgcctctcaacactcagaccttcaactgttttt

SEQ ID NO: 3812 - DNA, 50 bp, Homo sapiens
ccagtgacaccccatattcatcacaaaattaaagcaagaagtccatagta

SEQ ID NO: 3813 - DNA, 50 bp, Homo sapiens
tgacaccaagacccaccccaatccagacttcacacagtattctcccccac

SEQ ID NO: 3814 - DNA, 50 bp, Homo sapiens
gactgcaagtcactcttaggggctgtacttccttagtactggtagcatta

SEQ ID NO: 3815 - DNA, 50 bp, Homo sapiens
aactgagcatcacgaaccctgtttggcagactgaggtcacgatggagggg

SEQ ID NO: 3816 - DNA, 50 bp, Homo sapiens
tcctccattgaagaagaatgtcaacaagaaaggaaaaatagacaaactgg

SEQ ID NO: 3817 - DNA, 50 bp, Homo sapiens
aagtctcgaatgtaattggaatcttcacctcagagtggagttgaactgct

SEQ ID NO: 3818 - DNA, 50 bp, Homo sapiens; identical to SEQ ID NO: 1984

SEQ ID NO: 3819 - DNA, 50 bp, Homo sapiens
acaaaaatagctatatcaagggctggcacctagacattaaactgtacttt

SEQ ID NO: 3820 - DNA, 50 bp, Homo sapiens
gtccaccagtctctgaaattagaacagtaggcggtatgagataatcaggc

SEQ ID NO: 3821 - DNA, 50 bp, Homo sapiens
gaaatgtagctggagtcatcatttagcagagcacggtgtccctgggttgg

SEQ ID NO: 3822 - DNA, 50 bp, Homo sapiens
gcctctgtgatccccatgtgttttgattcctgctctttgttacagttcca

SEQ ID NO: 3823 - DNA, 50 bp, Homo sapiens
aaaacaagaaacaaatgtgcccaccccactttccgcttaactgaaaagct

SEQ ID NO: 3824 - DNA, 50 bp, Homo sapiens
gtaaaaaggctgtctgtgattttccagggtttggtgggggtagggagggg

SEQ ID NO: 3825 - DNA, 50 bp, Homo sapiens
ctgactgagtctcagaatgctcaggaccaaggtgcagagatggacaagag

SEQ ID NO: 3826 - DNA, 50 bp, Homo sapiens
agcttcttgggttcctaattcctggtgtttaataattctctccacgatca

SEQ ID NO: 3827 - DNA, 50 bp, Homo sapiens; identical to SEQ ID NO: 3328

SEQ ID NO: 3828 - DNA, 50 bp, Homo sapiens
atttccagtgagcttatcatgctgtctttacatggggttttcaattttgc

SEQ ID NO: 3829 - DNA, 50 bp, Homo sapiens
tgcagctcaccagccccaggggcagaagagacccaaccacttcctatttt

SEQ ID NO: 3830 - DNA, 50 bp, Homo sapiens; identical to SEQ ID NO: 2415

SEQ ID NO: 3831 - DNA, 50 bp, Homo sapiens
tgtatatagactctggtgttctattgctgagaagcaaaccgccctgcagc

SEQ ID NO: 3832 - DNA, 50 bp, Homo sapiens
atgtcagttctgttttaagtaacagaattgataactgagcaaggaaacgt

SEQ ID NO: 3833 - DNA, 50 bp, Homo sapiens
ttggagctaagctgccacctggttaattaaggtcccaacagtgagttgtg

SEQ ID NO: 3834 - DNA, 50 bp, Homo sapiens
ctttggagggtgtcttctgggtagagggatgggaaggaagggacccttac

SEQ ID NO: 3835 - DNA, 50 bp, Homo sapiens; identical to SEQ ID NO: 2332

SEQ ID NO: 3836 - DNA, 50 bp, Homo sapiens; identical to SEQ ID NO: 2120

SEQ ID NO: 3837 - DNA, 50 bp, Homo sapiens
tttggcttagtgttttcattgcaaattataattgctgtagagccacacac

SEQ ID NO: 3838 - DNA, 50 bp, Homo sapiens; identical to SEQ ID NO: 2596

SEQ ID NO: 3839 - DNA, 50 bp, Homo sapiens
aacaaaagatgaagacctagtgttttggatgggaagcacctgtagaccat

SEQ ID NO: 3840 - DNA, 50 bp, Homo sapiens
acatgtgcaaataaatgtggcttagacttgtgtgactgcttaagactaaa

SEQ ID NO: 3841 - DNA, 50 bp, Homo sapiens; identical to SEQ ID NO: 2583

SEQ ID NO: 3842 - DNA, 50 bp, Homo sapiens; identical to SEQ ID NO: 2141

SEQ ID NO: 3843 - DNA, 50 bp, Homo sapiens
cactcttcacctattgtatgaccaaataaaggttatgctgcttgttacgc

SEQ ID NO: 3844 - DNA, 50 bp, Homo sapiens
tgctaggtgatggagtagaaatggattccctctgggaatggtttcttggt

SEQ ID NO: 3845 - DNA, 50 bp, Homo sapiens
tatgaaaacagtggattggttgggttttgtgcagggtcttgggttagagc

SEQ ID NO: 3846 - DNA, 50 bp, Homo sapiens
tgcatggatcaatcagtgtgattagctttctcagcagacattgtgccata

SEQ ID NO: 3847 - DNA, 50 bp, Homo sapiens; identical to SEQ ID NO: 2356

SEQ ID NO: 3848 - DNA, 50 bp, Homo sapiens
gcagcacactctgagaaagaaacttatcctctcctacacataagaaacca

SEQ ID NO: 3849 - DNA, 50 bp, Homo sapiens
tgcaagacacctgtttatcatcttgtttaaatgtaaatgtccccttatgc

SEQ ID NO: 3850 - DNA, 50 bp, Homo sapiens
tcaacgccaatatgtattctacaaaagagaatggttttaggctccagtgt

SEQ ID NO: 3851 - DNA, 50 bp, Homo sapiens
tggatcatcaaggtgaaacactttggtattctttggcaatcagtgctcct

SEQ ID NO: 3852 - DNA, 50 bp, Homo sapiens
gatacactgtctctcttcataggactgtttaggctctgcatcaagattgc

SEQ ID NO: 3853 - DNA, 50 bp, Homo sapiens
aaggcagggatcatgacacctgaggagtctagtttatggcttcagttgga

SEQ ID NO: 3854 - DNA, 50 bp, Homo sapiens
atggatggactgatctgaaaatcgacctcaactcaagggtggtcagctca

SEQ ID NO: 3855 - DNA, 50 bp, Homo sapiens
tgctaatgtaatcggtttttgtaatggcgtcacaaataaaaggatgctta

SEQ ID NO: 3856 - DNA, 50 bp, Homo sapiens
tgcaagacatagaatagtgttggaaaatgtgcaatatgtgatgtggcaaa

SEQ ID NO: 3857 - DNA, 50 bp, Homo sapiens
aagtttgtgaatgtgactacttagtggtgtatatgagactttcaagggaa

SEQ ID NO: 3858 - DNA, 50 bp, Homo sapiens; identical to SEQ ID NO: 2253

SEQ ID NO: 3859 - DNA, 50 bp, Homo sapiens
ctgtgcctcccccgccacctgtgtgttcttttgatacatttatcttctgt

SEQ ID NO: 3860 - DNA, 50 bp, Homo sapiens
tgtatatttatggtgggaggtggttgggaacttttaacaaaatggggtgt

SEQ ID NO: 3861 - DNA, 50 bp, Homo sapiens
tcctttggaaacagaatgaagcagaggaaactcttaatacttaaaatcgt

SEQ ID NO: 3862 - DNA, 50 bp, Homo sapiens; identical to SEQ ID NO: 2625

SEQ ID NO: 3863 - DNA, 50 bp, Homo sapiens; identical to SEQ ID NO: 1910

SEQ ID NO: 3864 - DNA, 50 bp, Homo sapiens; identical to SEQ ID NO: 2474

SEQ ID NO: 3865 - DNA, 50 bp, Homo sapiens
tgcttgattaagatgccataatagtgctgtatttgcagtgtgggctaaga

SEQ ID NO: 3866 - DNA, 50 bp, Homo sapiens
tcttctgtttcatcctgcggttctggaaccagattttgacttgcgtgtca

SEQ ID NO: 3867 - DNA, 50 bp, Homo sapiens; identical to SEQ ID NO: 2515

SEQ ID NO: 3868 - DNA, 50 bp, Homo sapiens
atgcatctaccgctccttgggaaataatctgaaaggtctaaaaataaaaa

SEQ ID NO: 3869 - DNA, 50 bp, Homo sapiens
cgcaagaagcaggaagaggaaagagaagaaaagcacaacggggaaagata

SEQ ID NO: 3870 - DNA, 50 bp, Homo sapiens
gtagtgtgttgcatccctctcaccctctgatcttcgtcagtcgtgtcatg

SEQ ID NO: 3871 - DNA, 50 bp, Homo sapiens
gagggaaacccggtaataggctgggagtaatccacacacgtgctaacatt

SEQ ID NO: 3872 - DNA, 50 bp, Homo sapiens
cacacactgctacgtgacgtaccactactgccagcgcagcactagctcac

SEQ ID NO: 3873 - DNA, 50 bp, Homo sapiens
ggatcgtgacacaccgggttacacactttccacaccgtaattccatcaat

SEQ ID NO: 3874 - DNA, 50 bp, Homo sapiens
ggttgcaccaaggctgcctaggagaagtgcctgactggactaccccgatc

SEQ ID NO: 3875 - DNA, 50 bp, Homo sapiens
tctgccatctgtctatttcccaattttccttctgactgttcctttctcct

SEQ ID NO: 3876 - DNA, 50 bp, Homo sapiens
ctgtgatattttggtcatgggctggtctggtcggtttcccatttgtctgg

SEQ ID NO: 3877 - DNA, 50 bp, Homo sapiens
tacgacatttgcgaaattcgctaaaaacaagggggagttcacgcggccat

SEQ ID NO: 3878 - DNA, 50 bp, Homo sapiens
gcgcaggttaccggaacccaaggtcctttgaaattcacaactctctttgg

SEQ ID NO: 3879 - DNA, 50 bp, Homo sapiens
agctgtggaaagggcaacctgtggtttctctgtactggtgtttaatgggg

SEQ ID NO: 3880 - DNA, 50 bp, Homo sapiens
cacaaacacccgcccgagcaaccacagacacaggacacgacaccacacac

SEQ ID NO: 3881 - DNA, 50 bp, Homo sapiens
aaagggttacttttcaaaacagtctcctttcgaccggggtcagggtggcc

SEQ ID NO: 3882 - DNA, 50 bp, Homo sapiens
ggtggacagtataaggcggttaagatccgttgatggcgaaggtgagaatg

SEQ ID NO: 3883 - DNA, 50 bp, Homo sapiens
gacagagcgagtagacgggaggcggagaaggaagaggagacgagacgagg

SEQ ID NO: 3884 - DNA, 50 bp, Homo sapiens
caagacacagaggcaacggagagacacgcagacaagcaaggccacggaac

SEQ ID NO: 3885 - DNA, 50 bp, Homo sapiens
agggataggataattacagaggtactgagactcctggcgtgggtgactct

SEQ ID NO: 3886 - DNA, 50 bp, Homo sapiens
cccatcatgaaaaaacgccttaggagccgaagaagaaaacctcgggaaaa

SEQ ID NO: 3887 - DNA, 50 bp, Homo sapiens
gacacagcgagagtccaggaacaggcagacaagcgagaaagaggagaagc

SEQ ID NO: 3888 - DNA, 50 bp, Homo sapiens
gtaggaggcgagaaggaagaacaaggcacaccgaaggagcaagaccagac

SEQ ID NO: 3889 - DNA, 50 bp, Homo sapiens
caagaagcagaagcagcaaccagagacagagagacaaacgcagaacaaca

SEQ ID NO: 3890 - DNA, 50 bp, Homo sapiens
caacaagcagacgaacaacaacaaatatcaacgaggcgcagcagctcaaa

SEQ ID NO: 3891 - DNA, 50 bp, Homo sapiens
aacacacaagagaaacataaccactaaatcactacaaacacacacagaat

SEQ ID NO: 3892 - DNA, 50 bp, Homo sapiens
aaacgaattcttgcactgagagtgttcacagcgccactttcctcctcctc

SEQ ID NO: 3893 - DNA, 50 bp, Homo sapiens
cgagaagcagaagatgacagcagagcgaaagcagagaacgaacagacaag

SEQ ID NO: 3894 - DNA, 50 bp, Homo sapiens
ttggatttattaaagtccctttggaagtcttctaccattactgtagacca

SEQ ID NO: 3895 - DNA, 50 bp, Homo sapiens
tcacataccctatgccgactgagtggaacgagccgactatcacacagagc

SEQ ID NO: 3896 - DNA, 50 bp, Homo sapiens
cacatgcgcaataaacccggcgaagacgccactctgcggcaaaggacaca

SEQ ID NO: 3897 - DNA, 50 bp, Homo sapiens
ccgcagacacgaaagcaccaaccaccgaccgccaccagaaggaacaacag

SEQ ID NO: 3898 - DNA, 50 bp, Homo sapiens
gggcacttaaatggtcacctgtgtaacagtttggtgtaactcccagtgat

SEQ ID NO: 3899 - DNA, 50 bp, Homo sapiens
acaacacgaaaacgaacaagcaaagaaagaaaacggacacgagcgaacca

SEQ ID NO: 3900 - DNA, 50 bp, Homo sapiens; identical to SEQ ID NO: 3894

SEQ ID NO: 3901 - DNA, 50 bp, Homo sapiens
cagccatgtccatgacaaccagagcctgggaggagctggatggcggcctg

SEQ ID NO: 3902 - DNA, 50 bp, Homo sapiens
aaacacacagcaagaaccacgaaaagagcaacccaaaataggaaaagcgg

SEQ ID NO: 3903 - DNA, 50 bp, Homo sapiens
acagcgtggatataaggaccaagagactagggcgcatactatgattcgca

SEQ ID NO: 3904 - DNA, 50 bp, Homo sapiens
atggacacgaggacggaactgggggtactagaacaacccttctctgaaaa

SEQ ID NO: 3905 - DNA, 50 bp, Homo sapiens
agaccaaacgagaaggagaaaaagcaagaccacaaaagacaacaacagcg

SEQ ID NO: 3906 - DNA, 50 bp, Homo sapiens
aaaaaatcgggctttttctgggggaaagggaagggcggggaatgctggcc

SEQ ID NO: 3907 - DNA, 50 bp, Homo sapiens
ctacaacaatacagcacacagcataagcgcacagggcatagactaggcaa

SEQ ID NO: 3908 - DNA, 50 bp, Homo sapiens
caagagagtggagacgagtacgcgagaacgcacgacacagagcgcaagaa

SEQ ID NO: 3909 - DNA, 50 bp, Homo sapiens
tctgctgccctcttaagatctgactgccaaataaatcatcctcatgtcct

SEQ ID NO: 3910 - DNA, 50 bp, Homo sapiens
gatgagaaacaaccacaaggaagagggcagcgccggagacctacagaaag

SEQ ID NO: 3911 - DNA, 50 bp, Homo sapiens
gcgggggcactggctcttcacatttggttgcgagttgcacacaccacaac

SEQ ID NO: 3912 - DNA, 50 bp, Homo sapiens
gggggaagcggaagggttggattgggtgaaaaaagaattgttcgtgttta

SEQ ID NO: 3913 - DNA, 50 bp, Homo sapiens
ataatagaggagagatattgtaaatagagactggcagcagtttccacaaa

SEQ ID NO: 3914 - DNA, 50 bp, Homo sapiens
agtggcaggtgcaattgtcggttcgatttgtgttcccaacagtctgaaat

SEQ ID NO: 3915 - DNA, 50 bp, Homo sapiens
gagcccacggggaagggaacccagcaacacggaaataagttggaccgatc

SEQ ID NO: 3916 - DNA, 50 bp, Homo sapiens
acaacctgagaaataattcggtcaataccagactccaacattcctgatct

SEQ ID NO: 3917 - DNA, 50 bp, Homo sapiens
gtctattacaaagtaaagagagtcaattactccaggaggagaattgcagg

SEQ ID NO: 3918 - DNA, 50 bp, Homo sapiens
accagacacggacacacacgaacacaagaaaacacaaaacaagagcaacc

SEQ ID NO: 3919 - DNA, 50 bp, Homo sapiens
cggttgggtcctcaaaatatgcctgtttggttaacaaaagcggttgtgaa

SEQ ID NO: 3920 - DNA, 50 bp, Homo sapiens
gataaagaaggggcgcgggaaacagcgagggaaggacgggctgggagaac

SEQ ID NO: 3921 - DNA, 50 bp, Homo sapiens
atctctggcaatactgtctgattacgggggtgatgccgacggttaaaaac

SEQ ID NO: 3922 - DNA, 50 bp, Homo sapiens
gaacacaaaaaacctcttctataacggggacacacgccaaggggacaagt

SEQ ID NO: 3923 - DNA, 50 bp, Homo sapiens
ttgggtgcaacaaccaatacacttatacttggaaaccacgggccatatta

SEQ ID NO: 3924 - DNA, 50 bp, Homo sapiens
aggaggaacaaaaaccgcagcgtggatttcaaatttctggaagtaagtct

SEQ ID NO: 3925 - DNA, 50 bp, Homo sapiens
aaattcgcgcaccctttgttttattgccccggttacaaggttttgaactg

SEQ ID NO: 3926 - DNA, 50 bp, Homo sapiens
cgggccagtatgaatgtagggtcaaggaacgccgagggtttcacaaaagg

SEQ ID NO: 3927 - DNA, 50 bp, Homo sapiens
ctcagtgtagggcagagaggtctaacaccaacataaggtactagcagtgt

SEQ ID NO: 3928 - DNA, 50 bp, Homo sapiens
agaatatatgtattttgaaaggaaaggacttggggatttttaacagggca

SEQ ID NO: 3929 - DNA, 50 bp, Homo sapiens
gagactctcgttgtctcctcttctgctctcttctctgttggaggggagga

SEQ ID NO: 3930 - DNA, 50 bp, Homo sapiens
aggttgtggggagtatgtttggaccaaaaattaaaatattgtgggaggga

SEQ ID NO: 3931 - DNA, 50 bp, Homo sapiens
gaccttacctggtggttttgtggtttgttctcccgaaaaatgcggggttt

SEQ ID NO: 3932 - DNA, 50 bp, Homo sapiens
caccctgggttttaaagtgtgggagaaaagcgcccggaagaaggaaacaa

SEQ ID NO: 3933 - DNA, 50 bp, Homo sapiens
gaggggaccggccatctgggcaagcagatatgctaattgggaattatagg

SEQ ID NO: 3934 - DNA, 50 bp, Homo sapiens
atgacttgtgaatacctgagttatactttcccaacagatgtgcctaacac

SEQ ID NO: 3935 - DNA, 50 bp, Homo sapiens
tgatagctcacttagttaattgttttgaagcaaattttgggttggatggg

SEQ ID NO: 3936 - DNA, 50 bp, Homo sapiens
gacacagaagagagacagaagagaaacggtcgaggagaagaagcaggagc

SEQ ID NO: 3937 - DNA, 50 bp, Homo sapiens
aaagaccagagacagggagacacggcagacagagcgccgacaaagaagag

SEQ ID NO: 3938 - DNA, 50 bp, Homo sapiens
caaggcgacatgggagagcgagaaggctaggaggacgacagacaaggaaa

SEQ ID NO: 3939 - DNA, 50 bp, Homo sapiens
gaattttggggaggttactggtcgggggaaataacagggttggacaaacg

SEQ ID NO: 3940 - DNA, 50 bp, Homo sapiens
ctccacatatgggtaacacactcggtccttacaagcacctagtcacttcc

SEQ ID NO: 3941 - DNA, 50 bp, Homo sapiens
gggaccagactgctttctaaatgcacagctctttcactatcagaatgtgt

SEQ ID NO: 3942 - DNA, 50 bp, Homo sapiens
tgtggtcacttgggaaataaattccatctggcttacccaatgggtggtgg

SEQ ID NO: 3943 - DNA, 50 bp, Homo sapiens
ccacagccacaacaccagacaagccgaccaacagacagatacagaccacc

SEQ ID NO: 3944 - DNA, 50 bp, Homo sapiens
accacagcaagacaacaaggacgagaaagagaacagacaatgagcaacga

SEQ ID NO: 3945 - DNA, 50 bp, Homo sapiens
actactgcttgcgtacctctccgctttccctctccttactatcgaccata

SEQ ID NO: 3946 - DNA, 50 bp, Homo sapiens
tccgtttatattagcactgtatcccttgtgccatccaacattttgtatgt

SEQ ID NO: 3947 - DNA, 50 bp, Homo sapiens
cgggcgcaggacagtagcagagaagagaggtggagagccggacaacgcag

SEQ ID NO: 3948 - DNA, 50 bp, Homo sapiens
cttcagtcattatgggctcagtttcctcactattggttcctcgcaaggga

SEQ ID NO: 3949 - DNA, 50 bp, Homo sapiens
aagagcaacaacgaggcgaagaggaaggaggaggcaagacagaagaggaa

SEQ ID NO: 3950 - DNA, 50 bp, Homo sapiens
gaggagcaacgaccagagagacgaactgacatcaaccatagaagacgaca

SEQ ID NO: 3951 - DNA, 50 bp, Homo sapiens
aagcatgaagaagacctggatgaggctcagggaggttcccccagtttaaa

SEQ ID NO: 3952 - DNA, 50 bp, Homo sapiens
atcagtcaatcagtcagcttctcagagtagcaatccatgtgtccagagga

SEQ ID NO: 3953 - DNA, 50 bp, Homo sapiens
aaatccaatccttcggagagggaatgggcggtattaattaagggaagtcc

SEQ ID NO: 3954 - DNA, 50 bp, Homo sapiens
atgacaagacaagccagacgaagaagacaaacaagggagacacagcagac

SEQ ID NO: 3955 - DNA, 50 bp, Homo sapiens
tgcgccccaatatttgtggaacagcgttttgttcgaataaaacgatcggt

SEQ ID NO: 3956 - DNA, 50 bp, Homo sapiens
ctcgaggtgtaactcaggaaggcctagcgaatcccgactcggatggtgtc

SEQ ID NO: 3957 - DNA, 50 bp, Homo sapiens
ttcacctactctgttcttttcatccatcccctgagtcagttggttggagg

SEQ ID NO: 3958 - DNA, 50 bp, Homo sapiens
ctgttgtctggagtgtggagtctcttgtctggattgtggagtctcttgtc

SEQ ID NO: 3959 - DNA, 50 bp, Homo sapiens
caagatgatgcttgctgtcttttcctctcggctacccagaatggcatttg

SEQ ID NO: 3960 - DNA, 50 bp, Homo sapiens
agtactcatgacttgagagacgtggacggagccagcttctaccttgcttg

SEQ ID NO: 3961 - DNA, 50 bp, Homo sapiens
ggtccgaccaattaatgactccatgatcggcctcggttttcacaaacctt

SEQ ID NO: 3962 - DNA, 50 bp, Homo sapiens
agacaaagagagcataaatatagctctactcatgggtaccataccagtgt

SEQ ID NO: 3963 - DNA, 50 bp, Homo sapiens
ttacatttgtggaccatgttacagttaaagaaaaatcctgtttcagtcct

SEQ ID NO: 3964 - DNA, 50 bp, Homo sapiens
gcaggttatcgcaagatgtcttagagtagggttaaggttctcagtgacac

SEQ ID NO: 3965 - DNA, 50 bp, Homo sapiens
atttttaaatggctttaccaaacattgtcagtacctttacgtgttagaag

SEQ ID NO: 3966 - DNA, 50 bp, Homo sapiens
ctttccacagcaattgttttgtacgaggggccttacagcgcggtccactt

SEQ ID NO: 3967 - DNA, 50 bp, Homo sapiens
ttctacagcacgatgcctggatctactgacctgtcaaccacgaatcttga

SEQ ID NO: 3968 - DNA, 50 bp, Homo sapiens
gaaacagcaacaagcaaacaggatctcagcattaccaacagccagcacta

SEQ ID NO: 3969 - DNA, 50 bp, Homo sapiens
tgagcctgaacttttttagcaaattattattctcagtttccattacctgt

SEQ ID NO: 3970 - DNA, 50 bp, Homo sapiens
ccttccaaagcggtcacctgatagggaagtcttacggctaggaagttaca

SEQ ID NO: 3971 - DNA, 50 bp, Homo sapiens
gaatggtggggagaaaaaaggggggcacagtcatgatcggctcttataat

SEQ ID NO: 3972 - DNA, 50 bp, Homo sapiens
gtcacataatccggggacccaaagaaagttctccagagtggtttcacgag

SEQ ID NO: 3973 - DNA, 50 bp, Homo sapiens
acaacaacacatcacgtaaccacaacacgcataaacagcaaatcatccta

SEQ ID NO: 3974 - DNA, 50 bp, Homo sapiens
cagaacaccaacaagcagggacggaagccgaccgagcaaacagcgaaggg

SEQ ID NO: 3975 - DNA, 50 bp, Homo sapiens
gtggacggcctgggaatgtgccccccggtgtaacatcgagcccacaatgg

SEQ ID NO: 3976 - DNA, 50 bp, Homo sapiens
aggattaggagagggtcacagaacagaaagcagattacacttgggatgga

SEQ ID NO: 3977 - DNA, 50 bp, Homo sapiens
ctctgtttgtctggccgcctccgtgatcaaaccgtgtcgtcggcgtgttc

SEQ ID NO: 3978 - DNA, 50 bp, Homo sapiens
ggcttggacattgctctcaagaagattaagaaccctggaggaacactagg

SEQ ID NO: 3979 - DNA, 50 bp, Homo sapiens
tgtacagctaaatttctccaaagcactttttcaaaaccaaaaaagaaaaa

SEQ ID NO: 3980 - DNA, 50 bp, Homo sapiens
tttgcacactgaacacttacagatgtggcagatgtgaaatttgtcatcaa

SEQ ID NO: 3981 - DNA, 50 bp, Homo sapiens
acagagagtcacccgcgagtacgaaacaggcacatttttagaaactcaca

SEQ ID NO: 3982 - DNA, 50 bp, Homo sapiens
aggttcttaccaccacttttgtgcccatctttcccttcgttcccaatgtg

SEQ ID NO: 3983 - DNA, 50 bp, Homo sapiens
ccggggtggccctctcaaatttggcatggggtcctctttcaatgttgtgg

SEQ ID NO: 3984 - DNA, 50 bp, Homo sapiens
cacgagcggctggaggacacccattttgtgcagtgcccgtccgtcccttc

SEQ ID NO: 3985 - DNA, 50 bp, Homo sapiens; identical to SEQ ID NO: 834

SEQ ID NO: 3986 - DNA, 50 bp, Homo sapiens
ggtgtgtctcgcggctggcccagtctattctcggtgtttatcttcatcac

SEQ ID NO: 3987 - DNA, 50 bp, Homo sapiens
gacaacggaaactctgtctctaccaccatgtgacagacgcgttgatgcgt

SEQ ID NO: 3988 - DNA, 50 bp, Homo sapiens
caagacacaaacagcacgactcacacagagaaagcaaccatgccgaggag

SEQ ID NO: 3989 - DNA, 50 bp, Homo sapiens
cgcgtcgaacttcgggacattcccgtaaaccacaaacagataaagaatta

SEQ ID NO: 3990 - DNA, 50 bp, Homo sapiens
gcgtaaagtgatcaaaaggccctgaaggggaaaatgataaaacccgtggt

SEQ ID NO: 3991 - DNA, 50 bp, Homo sapiens
agaggaagcgtgtgaatacaacaatctaaaaaggaggagaggtcgagcac

SEQ ID NO: 3992 - DNA, 50 bp, Homo sapiens
acacattccccataccatttcgtgttattcacattccccgtaccatttct

SEQ ID NO: 3993 - DNA, 50 bp, Homo sapiens
taaaaagggggtggcggctgtagtaaggaggagcgagtaatgtatagcac

SEQ ID NO: 3994 - DNA, 50 bp, Homo sapiens
ccatgagcaggcgcaaccataacagttagagacggcacacagcacgacac

SEQ ID NO: 3995 - DNA, 50 bp, Homo sapiens
actcacgcaagagcagggggactataacagaaataaacaagtaaataaat

SEQ ID NO: 3996 - DNA, 50 bp, Homo sapiens
tacacaggcagctatgcggatcatcagacgagcacatattctaacagaga

SEQ ID NO: 3997 - DNA, 50 bp, Homo sapiens
cgtcgccgtaggacgcctccgtcgtcgtctggtctgtctcctgcatcgag

SEQ ID NO: 3998 - DNA, 50 bp, Homo sapiens
aaaggcaagagtccggggtggcagaagagtgaaaaatgaaagagagaagg

SEQ ID NO: 3999 - DNA, 50 bp, Homo sapiens
ttctgcccagagtgtatttgtgaagagtctcttatattatgttttgtgga

SEQ ID NO: 4000 - DNA, 50 bp, Homo sapiens
gtgcgaatgtggagtgttttacattgatctttgctaatgaattagcatca

SEQ ID NO: 4001 - DNA, 50 bp, Homo sapiens
cattacgcatattggtaagacgcaaaatgagacagatcgacactgggacg

SEQ ID NO: 4002 - DNA, 50 bp, Homo sapiens
cacaacgggtcttaatgacgacggaaagatacatccatcggtatgaacgc

SEQ ID NO: 4003 - DNA, 50 bp, Homo sapiens
accagcaatccgcagcagagtcataagtggggtaggtgatatgtactaac

SEQ ID NO: 4004 - DNA, 50 bp, Homo sapiens
gaaaaaacaagctaacaaacacacacgcccacaccaacatgccagaacgc

SEQ ID NO: 4005 - DNA, 50 bp, Homo sapiens
tgaacatgggtgggtttgatcacgaggattccgctgaaaagattagaggg

SEQ ID NO: 4006 - DNA, 50 bp, Homo sapiens
cgcgttcataacggcgtcgactgttcttgtgctgctgttatctatactat

SEQ ID NO: 4007 - DNA, 50 bp, Homo sapiens
gggaccagactacacggaataccagagttgaagaaaattaagatttaagc

SEQ ID NO: 4008 - DNA, 50 bp, Homo sapiens
tatactgagagtgaaggtctgggtgccaacttgagacaggtggtctagga

SEQ ID NO: 4009 - DNA, 50 bp, Homo sapiens
cccctggttttctcgttctgcctcctttggacctgtgtttgttttctgct

SEQ ID NO: 4010 - DNA, 50 bp, Homo sapiens
cccttagaatggttactgcccttgaattaacttgacacaacttgggttgg

SEQ ID NO: 4011 - DNA, 50 bp, Homo sapiens
cgaataatccctatttgattacctcagaaaagttttgtcttccgccaagg

SEQ ID NO: 4012 - DNA, 50 bp, Homo sapiens
ttggaccccagggtaaggcggatattggttgggacgttcggggagtgtat

SEQ ID NO: 4013 - DNA, 50 bp, Homo sapiens
aattacgttcggaggtatataaaaagggatcggcgcagtggatagggggt

SEQ ID NO: 4014 - DNA, 50 bp, Homo sapiens
ggagatccacagtgatctcaggccctggaccggaaaaggcagcaagatca

SEQ ID NO: 4015 - DNA, 50 bp, Homo sapiens
aagacgagtacaccaagaccaaagagcgccaacgagcacgaccgagtgaa

SEQ ID NO: 4016 - DNA, 50 bp, Homo sapiens
aacgccgactagacgtcacaaagacttaataagaaacacactgatatcca

SEQ ID NO: 4017 - DNA, 50 bp, Homo sapiens
cgcaacattatccatttaaacccctgcataacccattaccaaagccctct

SEQ ID NO: 4018 - DNA, 50 bp, Homo sapiens
ggcaccccaatccccggcaaaaacatttgttaacctcttgggaatttctt

SEQ ID NO: 4019 - DNA, 50 bp, Homo sapiens
ctcgtctgcaccggagtctcacaaatttagcatctgggtcttgagcatta

SEQ ID NO: 4020 - DNA, 50 bp, Homo sapiens
ccctccggggtctctatacccacaaccttctatcactcaatcagttggta

SEQ ID NO: 4021 - DNA, 50 bp, Homo sapiens
aacaagatagagagaagacgaagatcgacacagacaaacaaccacaaccg

SEQ ID NO: 4022 - DNA, 50 bp, Homo sapiens
tgttgggacccctcatctcacgggtcatttccaccactaaacgccctttt

SEQ ID NO: 4023 - DNA, 50 bp, Homo sapiens
ccctgaaatcctaaattccgtcacccctccaacatgaccataaaagtccc

SEQ ID NO: 4024 - DNA, 50 bp, Homo sapiens
gaccacgttatgtgcctgacttcgaggacaccctctctggtttggtattt

SEQ ID NO: 4025 - DNA, 49 bp, Homo sapiens
tctcctttcagttcctttgtaggatttctggccttgaggatagtcttca

SEQ ID NO: 4026 - DNA, 50 bp, Homo sapiens
tctcatcaacatttgactctcagaagagcctccatttgccctttctctct

SEQ ID NO: 4027 - DNA, 50 bp, Homo sapiens
gcagagcagaccttattacgcacaattgccggtaacatgtaacaccagtt

SEQ ID NO: 4028 - DNA, 50 bp, Homo sapiens
attgggcatggttggtccaatgcctcacatggccgggataacaggacgca

SEQ ID NO: 4029 - DNA, 50 bp, Homo sapiens
caaagggtgtaattccacattgacactcctgtcatgcggtgggcgggaac

SEQ ID NO: 4030 - DNA, 50 bp, Homo sapiens
ctagctcactagttgtgcctatatgccacaccgggggacccaacaagggt

SEQ ID NO: 4031 - DNA, 50 bp, Homo sapiens
atactgtgtgatttgcccttgctgtccaaccctgttcttgctgccattta

SEQ ID NO: 4032 - DNA, 50 bp, Homo sapiens
gtggcctgaagtgacccattctatgaattgttaattaaggtgccaaaaaa

SEQ ID NO: 4033 - DNA, 50 bp, Homo sapiens
gggtttgagacttgggtatggaaacagaaccggaaattgtgtgctctggt

SEQ ID NO: 4034 - DNA, 50 bp, Homo sapiens
atttctattatggaatccctggggttcagaatgtaactttgtacatgaga

SEQ ID NO: 4035 - DNA, 50 bp, Homo sapiens
gacagtacacctcagggaagggacaaacaaacacgataaatcgacacacg

SEQ ID NO: 4036 - DNA, 50 bp, Homo sapiens
tcagacccagtcttgtggatggaaatgtagtgctcgagtcacattctgct

SEQ ID NO: 4037 - DNA, 50 bp, Homo sapiens
tcctgagccccacacgcccgaagcaataaagagtccactgacttccaaaa

SEQ ID NO: 4038 - DNA, 50 bp, Homo sapiens
acgaatatcgaatctcccacgcggggggtgagacccgaatctgcggctgc

SEQ ID NO: 4039 - DNA, 50 bp, Homo sapiens
agacacacgagcaaaacgacgcagcaagaatcagatagcatagcaaacat

SEQ ID NO: 4040 - DNA, 50 bp, Homo sapiens
gcagtgggacggaacgggtgaagcctgatggctgatgcggcacgatcttg

SEQ ID NO: 4041 - DNA, 50 bp, Homo sapiens
ctttaaatcttagattgctccgcacagataaagagaaccaggattggggc

SEQ ID NO: 4042 - DNA, 50 bp, Homo sapiens
tttatttgggtacttttccccaacacaagtccttttatcccacccttggg

SEQ ID NO: 4043 - DNA, 50 bp, Homo sapiens
aaaagatctcggaaaatagcattttgttaaaaccttggggggtaaaaccc

SEQ ID NO: 4044 - DNA, 50 bp, Homo sapiens
aaccttcatgcaagtggagacgggtagggggttctatggggcattggttg

SEQ ID NO: 4045 - DNA, 50 bp, Homo sapiens
tgtgaaaagctgataagaaaaccatccagaaaaaagctcttcgttttaca

SEQ ID NO: 4046 - DNA, 50 bp, Homo sapiens
tcattataattctgtcctaggaaatcaaattagaacgctccacaagccgg

SEQ ID NO: 4047 - DNA, 50 bp, Homo sapiens
cgcagagctgggccttacaaatgggttccaaatcgggcttctcactcagg

SEQ ID NO: 4048 - DNA, 50 bp, Homo sapiens
tacaactgtaccacactgggttactctagaagtctctggtcggatccttc

SEQ ID NO: 4049 - DNA, 50 bp, Homo sapiens
catagagcacaagagacacatggaccggcacgcgacccgacccaaagcgc

SEQ ID NO: 4050 - DNA, 50 bp, Homo sapiens
tttacctcatttatttggtactttccccacacagtcctttatccacctgg

SEQ ID NO: 4051 - DNA, 50 bp, Homo sapiens
ccatttttagtgggggagaaaactgtcactgtgctggcgaaagaggtcca

SEQ ID NO: 4052 - DNA, 50 bp, Homo sapiens
ccgcaccgattaacggccagagaagcaacaagcaaataaaaagtgggaaa

SEQ ID NO: 4053 - DNA, 50 bp, Homo sapiens
aacttaactcactggcgagaatacagcgtgggacccttcagccactacaa

SEQ ID NO: 4054 - DNA, 50 bp, Homo sapiens
aggacttaacgggaatacgggaataactccaattacttcatctctagggc

SEQ ID NO: 4055 - DNA, 50 bp, Homo sapiens
aaggaggttgctcaccagtagtgcttgttaccaaaatgtcaccaggagtt

SEQ ID NO: 4056 - DNA, 50 bp, Homo sapiens
tgaattaagtgcattatcaattaaccttatggtggttggaatagtgatca

SEQ ID NO: 4057 - DNA, 50 bp, Homo sapiens
aaacacacaggaaaagggcaaagggggcaccaggagaaccgggagacaaa

SEQ ID NO: 4058 - DNA, 50 bp, Homo sapiens
cggagaaacggggccaaaaggttgccgagagacccggcgaaaaggacagg

SEQ ID NO: 4059 - DNA, 50 bp, Homo sapiens
acaaagcatcaaacagcagggagctagtggagaggtctattgtcccagtg

SEQ ID NO: 4060 - DNA, 50 bp, Homo sapiens
gggtgcatgccaagaaagtatggttggaattcctggtacactgaagtgga

SEQ ID NO: 4061 - DNA, 50 bp, Homo sapiens
atgttatcttgggaattagtgtcttgagcctctgtctgttaccgtagttt

SEQ ID NO: 4062 - DNA, 50 bp, Homo sapiens
tgaccgagtaaaaaacatctatcaattacacaaatgaacaagaatgtgag

SEQ ID NO: 4063 - DNA, 50 bp, Homo sapiens
acaagaaatggttgaggcgaatattggaaacacatgggcttaatgctgaa

SEQ ID NO: 4064 - DNA, 50 bp, Homo sapiens
ggtattgatgcttggtttttcctgccagtccgaaattcctgtatttgtca

SEQ ID NO: 4065 - DNA, 50 bp, Homo sapiens
tcatgctacttgtcctggttttgtcattgatactctcatagcccttttga

SEQ ID NO: 4066 - DNA, 50 bp, Homo sapiens
gcctggcggaccggcagcctatatgacggacttcctcattacttaccacg

SEQ ID NO: 4067 - DNA, 50 bp, Homo sapiens
aaactgtttggagaatttaagcactctctgatgggggacaactctatgga

SEQ ID NO: 4068 - DNA, 50 bp, Homo sapiens
tctttgtgcagatacgttcaccacataagtgtgagccatttaaacctggt

SEQ ID NO: 4069 - DNA, 50 bp, Homo sapiens
caccaaagtggagacaaatacatgatctcaaagatacacagtacctactt

SEQ ID NO: 4070 - DNA, 50 bp, Homo sapiens
aataattggtcttttaaacaaacacggaagtttggtggaatcggtcatgt

SEQ ID NO: 4071 - DNA, 50 bp, Homo sapiens
tgttcgtgccttccttctgggttccacaaaggtgggaccttacttatcta

SEQ ID NO: 4072 - DNA, 50 bp, Homo sapiens
agggaaaaacgcagggggttcaaaaactctctcactctatgcagtgtata

SEQ ID NO: 4073 - DNA, 50 bp, Homo sapiens
aagcagctcaatagcagcatagaggattagattaatggaacagcactgca

SEQ ID NO: 4074 - DNA, 50 bp, Homo sapiens
acatatacaaggacacagaggaaaggcgggaacaacgggaagaggttttg

SEQ ID NO: 4075 - DNA, 50 bp, Homo sapiens
tgtggcgattaagagaggtgaagcataactgatttgcaggatatggtttg

SEQ ID NO: 4076 - DNA, 50 bp, Homo sapiens
aaaagccaaaaggtttcatgtagattttagttcactaaagggtgcccaca

SEQ ID NO: 4077 - DNA, 50 bp, Homo sapiens
gcagaactctaattgtacggggtcacagaggcgtgatatggtatcccaaa

SEQ ID NO: 4078 - DNA, 50 bp, Homo sapiens
cttaaccatacagaatgatataactcctgtgcaatgaaggtgataacagt

SEQ ID NO: 4079 - DNA, 50 bp, Homo sapiens
cttcggaggctaggccgccgctccagctttgcacgtttcgatcccaaagg

SEQ ID NO: 4080 - DNA, 50 bp, Homo sapiens
caaagtcaaataactcctcattgtaaacaaactgtgtaactgcccaaagc

SEQ ID NO: 4081 - DNA, 50 bp, Homo sapiens
ccaatcccgatccaaatcataatttgttcttaagtatactgggcaggtcc

SEQ ID NO: 4082 - DNA, 50 bp, Homo sapiens
tccagctcctgttccttggaaaatctccattgtatgtgcattttttaaat

SEQ ID NO: 4083 - DNA, 50 bp, Homo sapiens
aactgatgcctgctagtgctttctgattactcgcattctgtttcttgctt

SEQ ID NO: 4084 - DNA, 50 bp, Homo sapiens
tcaggttgaagtcaagatgacagataaggtgagagtaatgactactccaa

SEQ ID NO: 4085 - DNA, 50 bp, Homo sapiens
tcctaggtagggtttaatccccagtaaaattgccatattgcacatgtctt

SEQ ID NO: 4086 - DNA, 50 bp, Homo sapiens; identical to SEQ ID NO: 2481

SEQ ID NO: 4087 - DNA, 50 bp, Homo sapiens
gaggccctagcatttctccttggataggggaccagagagagcttggaatg

SEQ ID NO: 4088 - DNA, 50 bp, Homo sapiens; identical to SEQ ID NO: 2188

SEQ ID NO: 4089 - DNA, 50 bp, Homo sapiens; identical to SEQ ID NO: 2057

SEQ ID NO: 4090 - DNA, 50 bp, Homo sapiens
tttacctctgtcttggctttcatgttattaaacgtatgcatgtgaagaag

SEQ ID NO: 4091 - DNA, 50 bp, Homo sapiens
gggaagttggtttataagcctttgccaggtgtaactgttgtgaaataccc

SEQ ID NO: 4092 - DNA, 50 bp, Homo sapiens
ccctcccttcagattatgttaactctgagtctgtccaaatgagttcactt

SEQ ID NO: 4093 - DNA, 50 bp, Homo sapiens; identical to SEQ ID NO: 3369

SEQ ID NO: 4094 - DNA, 50 bp, Homo sapiens; identical to SEQ ID NO: 2819

SEQ ID NO: 4095 - DNA, 50 bp, Homo sapiens
tatggccttcaagctcaagtccaaatcctgccatgacctctctgtactct

SEQ ID NO: 4096 - DNA, 50 bp, Homo sapiens
tccatctgtgcataaggagaggaaagttccagggtgtgtatgttttcagg

SEQ ID NO: 4097 - DNA, 50 bp, Homo sapiens
ggaccattccggagcagccccacatacctcactgtctcgtctgtctatgt

SEQ ID NO: 4098 - DNA, 50 bp, Homo sapiens; identical to SEQ ID NO: 3153

SEQ ID NO: 4099 - DNA, 50 bp, Homo sapiens; identical to SEQ ID NO: 2269

SEQ ID NO: 4100 - DNA, 50 bp, Homo sapiens
aaatctattctaacgcaaaaccactaactgaagttcagataatggatggt

SEQ ID NO: 4101 - DNA, 50 bp, Homo sapiens
tgttataaaagaggattttcccaccttgacaccaggcaatgtagttagca

SEQ ID NO: 4102 - DNA, 50 bp, Homo sapiens
accaggatgcaatggatttatttgattcaggggacctgtatttccatgtc

SEQ ID NO: 4103 - DNA, 50 bp, Homo sapiens
aacagaaacagctatggcaacagcatcaccctcagagcatcaccaacttg

SEQ ID NO: 4104 - DNA, 50 bp, Homo sapiens
tatttaacctgagtatagtatttaacgaagcctagaagcacggctgtggg

SEQ ID NO: 4105 - DNA, 50 bp, Homo sapiens; identical to SEQ ID NO: 860

SEQ ID NO: 4106 - DNA, 50 bp, Homo sapiens
atagcaagctgaactgtcctaaggcaggggcgagcacggaacaatggggc

SEQ ID NO: 4107 - DNA, 50 bp, Homo sapiens
tgacaggttcacttctgaggttgctatgagggtgatggaatgtactgcct

SEQ ID NO: 4108 - DNA, 50 bp, Homo sapiens; identical to SEQ ID NO: 2223

SEQ ID NO: 4109 - DNA, 50 bp, Homo sapiens
ttgaaattggtggcttcattctagatgtagcttgtgcagatgtagcagga

SEQ ID NO: 4110 - DNA, 50 bp, Homo sapiens
acttcttatacatttgataaagtaaggcatggttgtggttaatctggttt

SEQ ID NO: 4111 - DNA, 50 bp, Homo sapiens
catgaagaagcaagacgaaaacacacaggagggaaaatcctgggattctt

SEQ ID NO: 4112 - DNA, 50 bp, Homo sapiens
gcctggcttggaccttggcattccgtttgaattccttctaactggaacat

SEQ ID NO: 4113 - DNA, 50 bp, Homo sapiens
gtccactgtcactgtttctctgctgttgcaaatacatggataacacattt

SEQ ID NO: 4114 - DNA, 50 bp, Homo sapiens
ttgtgttgttggaaaaagtcacattgccattaaactttccttgtctgtct

SEQ ID NO: 4115 - DNA, 50 bp, Homo sapiens
cagtagcgacagcgacggcggagacgagggcgtgagtcaggaggagagac

SEQ ID NO: 4116 - DNA, 50 bp, Homo sapiens
agctgccacgggtgagagagcaggaggtatgaattaaaagtctacagcac

SEQ ID NO: 4117 - DNA, 50 bp, Homo sapiens
ctttcctcaaaatctttaagccagaggcagccttcctgccggagtggaca

SEQ ID NO: 4118 - DNA, 50 bp, Homo sapiens
tctgcctcacgtgcactgtggtggccgtgtgctacggctccttctacaat

SEQ ID NO: 4119 - DNA, 50 bp, Homo sapiens
ccatagcccaaggtgacatttcccaccctgtgccgtgttccccaataaaa

SEQ ID NO: 4120 - DNA, 50 bp, Homo sapiens
ggggtatccagaattggttgtaaatactttgcatattgtctgattaaaca

SEQ ID NO: 4121 - DNA, 50 bp, Homo sapiens
gaggctttgccttgcctgcatatttgtttcgctcttactcagtttgggaa

SEQ ID NO: 4122 - DNA, 50 bp, Homo sapiens; identical to SEQ ID NO: 3320

SEQ ID NO: 4123 - DNA, 50 bp, Homo sapiens
ttgcaaaacccagaagctaaaaagtcaataaacagaaagaatgattttga

SEQ ID NO: 4124 - DNA, 50 bp, Homo sapiens; identical to SEQ ID NO: 1636

SEQ ID NO: 4125 - DNA, 50 bp, Homo sapiens
aaaagaagccctaataaaccacccggataataaccctgtctaccatcttt

SEQ ID NO: 4126 - DNA, 50 bp, Homo sapiens
gtgaagattcctgaggatctaacttgcagttggacactatgttacatact

SEQ ID NO: 4127 - DNA, 50 bp, Homo sapiens
agaaggattagcagttcttagtaagtttactgtgtataggaacggtttgt

SEQ ID NO: 4128 - DNA, 50 bp, Homo sapiens
cggctgcctctcttgagaccatctgccaatcacacagtaactattcgggt

SEQ ID NO: 4129 - DNA, 49 bp, Homo sapiens
cccaactgaggaccactgtctacagagtcaggaaatattgtagggagaa

SEQ ID NO: 4130 - DNA, 50 bp, Homo sapiens; identical to SEQ ID NO: 2058

SEQ ID NO: 4131 - DNA, 50 bp, Homo sapiens; identical to SEQ ID NO: 3479

SEQ ID NO: 4132 - DNA, 50 bp, Homo sapiens
ggagccaagtccagatttacactgggagaggtgccagcaactgaataaat

SEQ ID NO: 4133 - DNA, 50 bp, Homo sapiens; identical to SEQ ID NO: 3789

SEQ ID NO: 4134 - DNA, 50 bp, Homo sapiens
taacttcaatgtagttttccatccttcaaataaacatgtctgcccccatg

SEQ ID NO: 4135 - DNA, 50 bp, Homo sapiens
gagtccttttgatttttaacttattccccatgtccctatacttcgtgtgc

SEQ ID NO: 4136 - DNA, 50 bp, Homo sapiens; identical to SEQ ID NO: 2854

SEQ ID NO: 4137 - DNA, 50 bp, Homo sapiens
cagcttcagctaggagtttgtaagcaaggactttgtgacacatttgtccc

SEQ ID NO: 4138 - DNA, 50 bp, Homo sapiens
aattgaaaagtaccaagaagtggaagaagaccaagacccatcatgcccca

SEQ ID NO: 4139 - DNA, 50 bp, Homo sapiens
acttcctagagacttgtttctgagacagttctttgccttcacttccctgc

SEQ ID NO: 4140 - DNA, 50 bp, Homo sapiens
acaactgacctgtctccttcacatagtccatatcaccacaaatcacacaa

SEQ ID NO: 4141 - DNA, 50 bp, Homo sapiens
gctcaggagcgggctgctgagagctaaacccagcaattttctatgatttt

SEQ ID NO: 4142 - DNA, 50 bp, Homo sapiens
aaagaaagccagtatattggtttgaaatatagagatgtgtcccaatttca

SEQ ID NO: 4143 - DNA, 50 bp, Homo sapiens
actggcaggcttatttatctgttgcacttggttagctttaattgttctgt

SEQ ID NO: 4144 - DNA, 50 bp, Homo sapiens; identical to SEQ ID NO: 2256

SEQ ID NO: 4145 - DNA, 50 bp, Homo sapiens
caactgtgctggccgggaggagagcagagacgcagtcctgcccagtgtag

SEQ ID NO: 4146 - DNA, 50 bp, Homo sapiens
cacatggctaaagaaggtttcagaaagaagtggggacagagcagaacttt

SEQ ID NO: 4147 - DNA, 50 bp, Homo sapiens
ccgacatctggttcctacttcagggtcataaagcctaaatagcccacacg

SEQ ID NO: 4148 - DNA, 50 bp, Homo sapiens
ctcatttgtattcaagcctttaacaggagggcaaagaggtgagaatgtgt

SEQ ID NO: 4149 - DNA, 50 bp, Homo sapiens; identical to SEQ ID NO: 1928

SEQ ID NO: 4150 - DNA, 50 bp, Homo sapiens
gcagacactgcttcttacttctgtgctacggatgggaacagagatgacaa

SEQ ID NO: 4151 - DNA, 50 bp, Homo sapiens
ggggaaactggaggcttcaaaactatctttggagcaggaacaagactatt

SEQ ID NO: 4152 - DNA, 50 bp, Homo sapiens
ggggaaggagggtgattatattgctttgtaatggtttgtgatacttgaaa

SEQ ID NO: 4153 - DNA, 50 bp, Homo sapiens
gtacgaatgggaggtcctcgacacctggggaactgcggactatgcggcag

SEQ ID NO: 4154 - DNA, 50 bp, Homo sapiens; identical to SEQ ID NO: 2478

SEQ ID NO: 4155 - DNA, 50 bp, Homo sapiens
tgacctccaccaaagcccatataaggagcggagttgttaaggactgaaga

SEQ ID NO: 4156 - DNA, 50 bp, Homo sapiens
tttctccggactcatcagtaaacctgtagaagtgtcgctttccagccttt

SEQ ID NO: 4157 - DNA, 50 bp, Homo sapiens; identical to SEQ ID NO: 3153

SEQ ID NO: 4158 - DNA, 50 bp, Homo sapiens
aaagttgatactgtgggttatttttgtgaacagcctgatgtttgggacct

SEQ ID NO: 4159 - DNA, 50 bp, Homo sapiens
aacttttacactttttccttccaacacttcttgattggctttgcagaaat

SEQ ID NO: 4160 - DNA, 50 bp, Homo sapiens
acagccaagacttaggttacagggcaacgcactactgttcagctttgaat

SEQ ID NO: 4161 - DNA, 50 bp, Homo sapiens
acgtgtcctgattttgccacaacctggatattgaagctatccaagctttt

SEQ ID NO: 4162 - DNA, 50 bp, Homo sapiens; identical to SEQ ID NO: 2915

SEQ ID NO: 4163 - DNA, 50 bp, Homo sapiens; identical to SEQ ID NO: 923

SEQ ID NO: 4164 - DNA, 50 bp, Homo sapiens
ccaatgacagcctacctattaccaagggctcccctacaactctgaacctt

SEQ ID NO: 4165 - DNA, 50 bp, Homo sapiens
gacaaaccctggagaaatgggagcttggggagaggatgggagtgggcaga

SEQ ID NO: 4166 - DNA, 50 bp, Homo sapiens
gtgtcagtgcccaaaggagggaggttgatggtgcttaacaaacatgaagt

SEQ ID NO: 4167 - DNA, 50 bp, Homo sapiens
tcattgtataaaagctgttatgtgcaacagtgtggagattccttgtctga

SEQ ID NO: 4168 - DNA, 50 bp, Homo sapiens; identical to SEQ ID NO: 4155

SEQ ID NO: 4169 - DNA, 50 bp, Homo sapiens
ttggcttcattacgagagagaaacataacagaggcagtgatggtttcaga

SEQ ID NO: 4170 - DNA, 50 bp, Homo sapiens; identical to SEQ ID NO: 3706

SEQ ID NO: 4171 - DNA, 50 bp, Homo sapiens
agcacattgggagatacatgataaatttctatctgcagttgctatttgca

SEQ ID NO: 4172 - DNA, 50 bp, Homo sapiens
ggcccagcagaagagcctccttcagcagctactgactgaataaccacttt

SEQ ID NO: 4173 - DNA, 50 bp, Human cytomegalovirus
aataatagattagcagaaggaataatccgtgcgaccgagcttgtgcttct

SEQ ID NO: 4174 - DNA, 50 bp, Human cytomegalovirus
acattcaaaagtttgagcgtcttcatgtacgccgttttcggcctcacgag

SEQ ID NO: 4175 - DNA, 50 bp, Human cytomegalovirus
acgaacagaaatctcaaaagacgctgacccgataagtaccgtcacggaga

SEQ ID NO: 4176 - DNA, 50 bp, Human cytomegalovirus
aggaaccagcaagtcaacaaaagactaacaaagaaaaaccatcttggaat

SEQ ID NO: 4177 - DNA, 50 bp, Human cytomegalovirus
ccaacgacacatccacaaaaatcccccatcgactctcacaatcgcatcat

SEQ ID NO: 4178 - DNA, 50 bp, Human cytomegalovirus
cctctggaggcaagagcacccaccctatggtgactagaagcaaggctgac

SEQ ID NO: 4179 - DNA, 50 bp, Human cytomegalovirus
gatgtccgtctacgcgctatcggccatcatcggcatctatctgctctacc

SEQ ID NO: 4180 - DNA, 50 bp, Human cytomegalovirus
ttcgtgggcaccaagtttcgcaagaactacactgtctgctggccgagttt

SEQ ID NO: 4181 - DNA, 50 bp, Human cytomegalovirus
gagatcgacatcgtcatcgaccgacctccgcagcaacccctacccaatcc

SEQ ID NO: 4182 - DNA, 50 bp, Human cytomegalovirus
ctttgagcaggttctcaaggctgtaactaacgtgctgtcgcccgtctttc

SEQ ID NO: 4183 - DNA, 50 bp, Human cytomegalovirus
tcttctgggacgccaacgacatctaccgcatcttcgccgaattggaaggc

SEQ ID NO: 4184 - DNA, 50 bp, Human cytomegalovirus
agagaacaacaaaaccaccacgacgatgaaacaaaacgctcaaccaaaca

SEQ ID NO: 4185 - DNA, 50 bp, Human cytomegalovirus
gagaaaagattgtgcgatctccccctggtttccagcagactcttgccaga

SEQ ID NO: 4186 - DNA, 50 bp, Human cytomegalovirus
catcttctccaccaaccagggtgggttcatgctgcctatctacgagacgg

SEQ ID NO: 4187 - DNA, 50 bp, Homo sapiens
tcccatgttccctttatttgtcttttggttctgctttttgggagattttt

SEQ ID NO: 4188 - DNA, 50 bp, Homo sapiens
tggtgcgcttttgtgtgcggtggaggagttcctaaccctcggcttgtttt

SEQ ID NO: 4189 - DNA, 50 bp, Homo sapiens
gccgttggttggcttaaacttggtttcgtcacttcgggcactttggtttt

SEQ ID NO: 4190 - DNA, 50 bp, Homo sapiens
ctggcctcccctggctctttaagctcccctttggttaaaaactgggtttt

SEQ ID NO: 4191 - DNA, 50 bp, Homo sapiens
aaaaggccaagggtgttgttggggcgtctgtctaatgtggtgggtctttt

SEQ ID NO: 4192 - DNA, 50 bp, Homo sapiens
gctgtaaatctctgtctcatcatccttctcttttgtttccatagcctttt

SEQ ID NO: 4193 - DNA, 50 bp, Homo sapiens
gtgtgtgctggctgagaagccactgtgaattgattcttcttctgaagttt

SEQ ID NO: 4194 - DNA, 50 bp, Homo sapiens
aataagggtgttgccctttgttccctcacataatcgtgaaaggctgcttt

SEQ ID NO: 4195 - DNA, 50 bp, Homo sapiens
ttcctcagtccctgttcataccatctctgcacccacaatcacactgattt

SEQ ID NO: 4196 - DNA, 50 bp, Homo sapiens
gaccacagatatgcactccttacattaacctcagccttgatgtatcattt

SEQ ID NO: 4197 - DNA, 50 bp, Homo sapiens
ccccctgttatgaaaagggttaaacttgaacccacccattttaaaaattt

SEQ ID NO: 4198 - DNA, 50 bp, Homo sapiens
ttatagctaccagaagccaccagggccttagcccagcagtagaaacctct

SEQ ID NO: 4199 - DNA, 50 bp, Homo sapiens
gatcagtagacacacccctcaatgctgcgaagaaaatgaaggccactctt

SEQ ID NO: 4200 - DNA, 50 bp, Homo sapiens
agcagacaatggacaactgtagtttttgaattgacttctatagccatctt

SEQ ID NO: 4201 - DNA, 50 bp, Homo sapiens
tccaccacagtgcatgataattccgacagaacggccttttatttgtacct

SEQ ID NO: 4202 - DNA, 50 bp, Homo sapiens
tgttctctgaactgtctggatgaaccggtcaacggcactcatcatacctt

SEQ ID NO: 4203 - DNA, 50 bp, Homo sapiens
gcttcactctgctttctgtataaagggcagtctgtggtcacgcaagactt

SEQ ID NO: 4204 - DNA, 50 bp, Homo sapiens
agcaaagaccaaattctccttgggaagtgtgggagcaggctgacattatt

SEQ ID NO: 4205 - DNA, 50 bp, Homo sapiens
gtcctttgatagcagaacaagaggctctgtgatcctctggacctcagatt

SEQ ID NO: 4206 - DNA, 50 bp, Homo sapiens
tccacgacatggtacagctcttcactttttcagctttttaaatgtccatt

SEQ ID NO: 4207 - DNA, 50 bp, Homo sapiens
gacaaggcaatgctactgatcacctgaggataatggtgaaggacttttgt

SEQ ID NO: 4208 - DNA, 50 bp, Homo sapiens
tcaatagttgtgaaattcttctcaggctccttaaaccctcgctttgttgt

SEQ ID NO: 4209 - DNA, 50 bp, Homo sapiens
aggcttacgtttatccaaaagcatttcaccttgcacattactgttgttgt

SEQ ID NO: 4210 - DNA, 50 bp, Homo sapiens
acaagcatttagatcataacatggtaaagcctattaccagccaatgttgt

SEQ ID NO: 4211 - DNA, 50 bp, Homo sapiens
tgttttggcatagagctttacttaaaatgctgcttcattttacacattgt

SEQ ID NO: 4212 - DNA, 50 bp, Homo sapiens
tggagctcaattctatgcagttgtgctgatatttcattaagtcactgtgt

SEQ ID NO: 4213 - DNA, 50 bp, Homo sapiens
tttccccttggcctgagtttttataaaatttccattaattggggcagtgt

SEQ ID NO: 4214 - DNA, 50 bp, Homo sapiens
tgcagctaaattcgaagcttttggtctatattgttaattgccattgctgt

SEQ ID NO: 4215 - DNA, 50 bp, Homo sapiens
ggatttggaagatgctttcagaaatatggcataggtttttgtcgaaatgt

SEQ ID NO: 4216 - DNA, 50 bp, Homo sapiens
aaagaaaaattcagcctgaaccctacccttataaaacaggttaattgggt

SEQ ID NO: 4217 - DNA, 50 bp, Homo sapiens
tgtaagtcccatgcccgaatttggagatttgggtttttcttttcaggggt

SEQ ID NO: 4218 - DNA, 50 bp, Homo sapiens
cggattccaaattacttaaagcctttatgggaacacggtagattgtaggt

SEQ ID NO: 4219 - DNA, 50 bp, Homo sapiens
gccttctggcctctgaggcaaaggtcagtgatactgatgggagggtaggt

SEQ ID NO: 4220 - DNA, 50 bp, Homo sapiens
gctcaagatcacctctttgtcatcttgaacaatgtttttctcttctaggt

SEQ ID NO: 4221 - DNA, 50 bp, Homo sapiens
tgtttccacttcatgggatatgactccatcacaatgaaaatgggtccagt

SEQ ID NO: 4222 - DNA, 50 bp, Homo sapiens
ttgtgattgtaaatcatgtatgtacaaatgccatgaaaattaaagccagt

SEQ ID NO: 4223 - DNA, 50 bp, Homo sapiens
tttcccttatgcaccttccagtctttggcaggacatgatttatggacagt

SEQ ID NO: 4224 - DNA, 50 bp, Homo sapiens
tgcactctaccagatttgaacatctagtgaggttcacattcatactaagt

SEQ ID NO: 4225 - DNA, 50 bp, Homo sapiens
tcaactgcagggaatctcctaggaagcggataaatctggcaattggaagt

SEQ ID NO: 4226 - DNA, 50 bp, Homo sapiens
accaccagctatttgtaattccttcttctaaggcatagtgaaaacttgct

SEQ ID NO: 4227 - DNA, 50 bp, Homo sapiens
tcgctttctaactgattccattccaccatgtcagatactcctgggctgct

SEQ ID NO: 4228 - DNA, 50 bp, Homo sapiens
cagcaatgaggggatatttttgatgagctggaatatccaattgaacagct

SEQ ID NO: 4229 - DNA, 50 bp, Homo sapiens
ccccctaagttaaaagctctgtctttttggggtttgccctatgtaaagct

SEQ ID NO: 4230 - DNA, 50 bp, Homo sapiens
gaagcctctactcttgagtctctttcattactggggatgtaaatgttcct

SEQ ID NO: 4231 - DNA, 50 bp, Homo sapiens
acacttgatctcttccttatttctctcagaaaacctgtaggattgtgcct

SEQ ID NO: 4232 - DNA, 50 bp, Homo sapiens
agtagatattttgccggtgtacttggaatacctttcagaagccaaaccct

SEQ ID NO: 4233 - DNA, 50 bp, Homo sapiens
aattccaatcctggtatatagcacctggtattatgggtaccaaaaaccct

SEQ ID NO: 4234 - DNA, 50 bp, Homo sapiens
actgctccaaatatcaaccccatgtaggcaggatgtttgatcttggtact

SEQ ID NO: 4235 - DNA, 50 bp, Homo sapiens
tgttgttggatacgtacttaactggtatgcatcccatgtctttgggtact

SEQ ID NO: 4236 - DNA, 50 bp, Homo sapiens
ttaggattgctcagtttcatcaaggtttgaaggataggcaggctctcact

SEQ ID NO: 4237 - DNA, 50 bp, Homo sapiens
ggccagtctctgtgtgtcttaatcccttgtccttcattaaaagcaaaact

SEQ ID NO: 4238 - DNA, 50 bp, Homo sapiens
gcattcccggtcactccctccctaatctgagcatcactcaagctctttat

SEQ ID NO: 4239 - DNA, 50 bp, Homo sapiens
ctgaatgccaagagcttcaagagtgtgtgtaaataaagccacacctttat

SEQ ID NO: 4240 - DNA, 50 bp, Homo sapiens
cccgaggaggaagacgaatcgttaaacatctgaaagggtcaggtgagtat

SEQ ID NO: 4241 - DNA, 50 bp, Homo sapiens
caaacttgttctgaagacaatttccaaggttgtcagccatgtcaccatat

SEQ ID NO: 4242 - DNA, 50 bp, Homo sapiens
tcaggttcgtgttaaacgctgtatgttaactatgactggaattctgtgat

SEQ ID NO: 4243 - DNA, 50 bp, Homo sapiens
atggagatccagagacgttggttttcaaatggagcaaacagcactgtgat

SEQ ID NO: 4244 - DNA, 50 bp, Homo sapiens
agctttaggctgagggcatggaaactgttacgcttttccttttatgtgat

SEQ ID NO: 4245 - DNA, 50 bp, Homo sapiens
tcactccagaatagaaattagagtataggtaggcagtccaacctctgcat

SEQ ID NO: 4246 - DNA, 50 bp, Homo sapiens
tcagatgccacacttatgagaccctcatccttctgctcactctcttccat

SEQ ID NO: 4247 - DNA, 50 bp, Homo sapiens
ccctgcctttacctctctacttgtagtgttctttcagagcctgctcccat

SEQ ID NO: 4248 - DNA, 50 bp, Homo sapiens
caaaacaagatgtgccagggcctgggggatgggataatttcagagagaat

SEQ ID NO: 4249 - DNA, 50 bp, Homo sapiens
acccaagagggcagcagttgtgtcatccagttcatcttaagaatttcaat

SEQ ID NO: 4250 - DNA, 50 bp, Homo sapiens
ggggtaggaagaggatggaattgagatgtttgagcctcatttacatcaat

SEQ ID NO: 4251 - DNA, 50 bp, Homo sapiens
gctctctgatgctggtggctgttcccccagaatggaagcattgattaaat

SEQ ID NO: 4252 - DNA, 50 bp, Homo sapiens
ggggagaagtgatatggtgaagggaagtggggagtatttgaacacagttg

SEQ ID NO: 4253 - DNA, 50 bp, Homo sapiens
caccatgcctcacttttagcgcagtgtgatcctacacaaattgccctgtg

SEQ ID NO: 4254 - DNA, 50 bp, Homo sapiens
tatggtttttaggctatgcagatattctgttggtttttgagacagctctg

SEQ ID NO: 4255 - DNA, 50 bp, Homo sapiens
ccttcctttctaaggcataagtgcgacgttcgctgctgtgcgtggaactg

SEQ ID NO: 4256 - DNA, 50 bp, Homo sapiens
gagaggaaggcagacaggcagccattttaagagagaagagccagacaatg

SEQ ID NO: 4257 - DNA, 50 bp, Homo sapiens
gttatcaaaggtggaatcggaaacaccaggctcctagtgccacggaaatg

SEQ ID NO: 4258 - DNA, 50 bp, Homo sapiens
aaatgtgcctattgctagagctcctccctctcaacacccagtttccttgg

SEQ ID NO: 4259 - DNA, 50 bp, Homo sapiens
caatcgtcttatctctacagagagaagtggaaaattctttttcaaggggg

SEQ ID NO: 4260 - DNA, 50 bp, Homo sapiens
ctatggaaggcagttggtgggcaaaagtccggtttttacgctttgagggg

SEQ ID NO: 4261 - DNA, 50 bp, Homo sapiens
gtctgatccttagaccgtctcatcacagcaaccctaactgcagagcaggg

SEQ ID NO: 4262 - DNA, 50 bp, Homo sapiens
aatggtaagaaatgccttgtgtgggtggccctccagtccccagtccaggg

SEQ ID NO: 4263 - DNA, 50 bp, Homo sapiens
aacatatccagggaggacaaactctgggctggacaatgtatccacaaggg

SEQ ID NO: 4264 - DNA, 50 bp, Homo sapiens
gcccatggtcctagaattaattcccctaaaaatttttgaaataggggcgg

SEQ ID NO: 4265 - DNA, 50 bp, Homo sapiens
gccaactgcttagaagcccaacacaacccatctggtctcttgaataaagg

SEQ ID NO: 4266 - DNA, 50 bp, Homo sapiens
gagcccttaaaattactgtatctcctctaaagtgtgatttaatggctgcg

SEQ ID NO: 4267 - DNA, 50 bp, Homo sapiens
cttttgctggagactcatcgctttgggaagtgcatttgcttcgtcgtccg

SEQ ID NO: 4268 - DNA, 50 bp, Homo sapiens
cccagttcacagtagagaggtggagcttagtacttcctgctgcccattag

SEQ ID NO: 4269 - DNA, 50 bp, Homo sapiens
ctgggctgtaggtactgctgggtcactgttgctataaatggtcactggag

SEQ ID NO: 4270 - DNA, 50 bp, Homo sapiens
ctttagatgtcccacgtcccttcaagcacatgaaagagctcacactggag

SEQ ID NO: 4271 - DNA, 50 bp, Homo sapiens
gactctggaactcgagcgtgtggctgctgcgccgacagctgaatctagag

SEQ ID NO: 4272 - DNA, 50 bp, Homo sapiens
ccttagagatcgtgacccttcctgcttgcctccctggtgggctctttcag

SEQ ID NO: 4273 - DNA, 50 bp, Homo sapiens
agagtgagaaggcagttccagttttagcacagatttgtttatgtgttcag

SEQ ID NO: 4274 - DNA, 50 bp, Homo sapiens
tctcaagagagaacgccacagcagagagacccaatccgcctaagttgcag

SEQ ID NO: 4275 - DNA, 50 bp, Homo sapiens
aggtttggggaggggtcccagtctgcgatcctttctccctcttcgtgcag

SEQ ID NO: 4276 - DNA, 50 bp, Homo sapiens
cctcagcttccaactctgattccaggacaggatggaaaacctttggacag

SEQ ID NO: 4277 - DNA, 50 bp, Homo sapiens
aatcccttgtaccatgtatacaaatgagacaagtgagcttgacattcaag

SEQ ID NO: 4278 - DNA, 50 bp, Homo sapiens
gctacagcccggaacacaaaagaagacacccatgcaaataccattaaaag

SEQ ID NO: 4279 - DNA, 50 bp, Homo sapiens
attaaccctttattgccctagccagtggggtgggagggagagattgtttc

SEQ ID NO: 4280 - DNA, 50 bp, Homo sapiens
gttatccttaggccaggtctcccacctttgagccggacaaaaccagagtc

SEQ ID NO: 4281 - DNA, 50 bp, Homo sapiens
tgctgctacagttgcaaaacactggagctagagaaaataaagtactgatc

SEQ ID NO: 4282 - DNA, 50 bp, Homo sapiens
cgagagtcttgctgagccaggacttgagtgcctcgaagttttcaatgatc

SEQ ID NO: 4283 - DNA, 50 bp, Homo sapiens
atcaggagagggagataattagttgcttcctccttcacactgtttgaatc

SEQ ID NO: 4284 - DNA, 50 bp, Homo sapiens
ttgccctttcctctcactgccttttatagccaatatcaatgtctctttgc

SEQ ID NO: 4285 - DNA, 50 bp, Homo sapiens
atccctattgccagacacatcattctctccatccagaaagccaactttgc

SEQ ID NO: 4286 - DNA, 50 bp, Homo sapiens
ctctcttcatcttctgattgggattgtgtccagtcctctgcttcttctgc

SEQ ID NO: 4287 - DNA, 50 bp, Homo sapiens
gagggttctagcaacttaatcccattagcatgttagctgaagactactgc

SEQ ID NO: 4288 - DNA, 50 bp, Homo sapiens
gtcccaagggtcagtatattggaggaaagtaaaggagtgaatcagactgc

SEQ ID NO: 4289 - DNA, 50 bp, Homo sapiens
ctggaattactaatgtggaggtgatctgagaactgggaacaaagtagggc

SEQ ID NO: 4290 - DNA, 50 bp, Homo sapiens
tccagggactgacaagagtgagtggtgtcaacctaaagagaaactcaggc

SEQ ID NO: 4291 - DNA, 50 bp, Homo sapiens
cagaactccatagacagcctcactttgtgctcgggggcctgtcccaaggc

SEQ ID NO: 4292 - DNA, 50 bp, Homo sapiens
gcacttctcccggttcatccctctcaagtaatggctcagctaataaaggc

SEQ ID NO: 4293 - DNA, 50 bp, Homo sapiens
tccatctcctttctactgtagcggagactacaagtcccaggatgccccgc

SEQ ID NO: 4294 - DNA, 50 bp, Homo sapiens
ccacattcttgctgtccacatcctgctgggtgaaattgtgttgaagtagc

SEQ ID NO: 4295 - DNA, 50 bp, Homo sapiens
tgactgtcttggtaattttcttccttgttttacttctggaaactgggagc

SEQ ID NO: 4296 - DNA, 50 bp, Homo sapiens
tgactttcaggaatgtcagcattgacctctccttgccactgttactcagc

SEQ ID NO: 4297 - DNA, 50 bp, Homo sapiens
aagtttgtgcagcacattcctgagtgtacgatattgacctgtagcccagc

SEQ ID NO: 4298 - DNA, 50 bp, Homo sapiens; identical to SEQ ID NO: 4297

SEQ ID NO: 4299 - DNA, 50 bp, Homo sapiens
accagacttcaggaagaataaaggtcgccaactcaataaaaccaccaagc

SEQ ID NO: 4300 - DNA, 50 bp, Homo sapiens
acttgccacataaacagttccatcataaaaactcttccccttcttgttcc

SEQ ID NO: 4301 - DNA, 50 bp, Homo sapiens
gcttccttgaaccacccagaaatccactcaaatttggggattgtcattcc

SEQ ID NO: 4302 - DNA, 50 bp, Homo sapiens
gggggtgatgggttaattaaataagtccattcctgggatttgagggggcc

SEQ ID NO: 4303 - DNA, 50 bp, Homo sapiens
atgcccctcgtcctagaattaattcccctaaaaatctttgaaatagggcc

SEQ ID NO: 4304 - DNA, 50 bp, Homo sapiens
tcaaactaagaccagggttgaaaactatggcccagggaccacttccagcc

SEQ ID NO: 4305 - DNA, 50 bp, Homo sapiens
gacgcgcacacaccttgagtgacagcgacctcttctctacaggttttccc

SEQ ID NO: 4306 - DNA, 50 bp, Homo sapiens
atccaagctttaattctgccatctcagaatggtgataaaccatttctccc

SEQ ID NO: 4307 - DNA, 50 bp, Homo sapiens
tacttcattgctattgtaaaccaaaaataaaatttgaagccccctgcccc

SEQ ID NO: 4308 - DNA, 50 bp, Homo sapiens
cttcatcactcaggaaacagaaaaggcttcagaaggagcggccatgcccc

SEQ ID NO: 4309 - DNA, 50 bp, Homo sapiens
agaacccgtattcataaaatttagaccaaaaaggaaggaatcgaaccccc

SEQ ID NO: 4310 - DNA, 50 bp, Homo sapiens
ttttctattttcatctgtcattttcactgcagagcgcacctcccggaccc

SEQ ID NO: 4311 - DNA, 50 bp, Homo sapiens
agactgaaggggttgaaagacccgtagacgctcctttcctcttttagacc

SEQ ID NO: 4312 - DNA, 50 bp, Homo sapiens
ctctgcggccctagagttaatcccatcagccgaggtgaggcacctgttac

SEQ ID NO: 4313 - DNA, 50 bp, Homo sapiens
ccaattccgcagtacagagcattcagcaggtagtggtgaccctgggtgac

SEQ ID NO: 4314 - DNA, 50 bp, Homo sapiens
ggctccagccaccggcagctctgaaagagtttgaagaatttattgttcac

SEQ ID NO: 4315 - DNA, 50 bp, Homo sapiens; identical to SEQ ID NO: 238

SEQ ID NO: 4316 - DNA, 50 bp, Homo sapiens
cactggaacacaacccagccatgaaaaggaagaagctctgactcaggcac

SEQ ID NO: 4317 - DNA, 50 bp, Homo sapiens
catctcatgcgtagcactgatcaatgtgccccagggtgtgtattcgccac

SEQ ID NO: 4318 - DNA, 50 bp, Homo sapiens
caatcagagcgcgagttacaagcgcggtggagtggggaagcgaatgaaac

SEQ ID NO: 4319 - DNA, 50 bp, Homo sapiens
gacattgcacatttttgaacctgtctacagcagcctgggttggtcacaac

SEQ ID NO: 4320 - DNA, 50 bp, Homo sapiens
acactggcagagtccagaaaagcagcagaagaaaaattcagagcaaaaac

SEQ ID NO: 4321 - DNA, 50 bp, Homo sapiens
tttaacgtgcttctgagacagccaccaccgaaaggcacctttagcggtta

SEQ ID NO: 4322 - DNA, 50 bp, Homo sapiens
tcagccaacctgaatctggtatctttacttaaacacagcagttgtagtta

SEQ ID NO: 4323 - DNA, 50 bp, Homo sapiens
aaaaggagacgatgtcaggcaaacactccttaccctgccatttctagtta

SEQ ID NO: 4324 - DNA, 50 bp, Homo sapiens
tcacaatcagtctcagattcccagcagcagagagtgaattgtatgttgta

SEQ ID NO: 4325 - DNA, 50 bp, Homo sapiens
taaagacaatgctatttaagtgcacagttccaggggcgcttgtggctcta

SEQ ID NO: 4326 - DNA, 50 bp, Homo sapiens
gaagaccaagtctacgcctgcaagctctcagaccgggaacatccactcta

SEQ ID NO: 4327 - DNA, 50 bp, Homo sapiens
ctgaagagacagaaagggagacaccaaaactttaatggcagttattccta

SEQ ID NO: 4328 - DNA, 50 bp, Homo sapiens
gccgcccccatgaagccctttcttactgtaagtgctcaagaacaaagata

SEQ ID NO: 4329 - DNA, 50 bp, Homo sapiens
gctagcacgactctgccttgttcctttggagacaattgttatcatcaata

SEQ ID NO: 4330 - DNA, 50 bp, Homo sapiens
attgggaatatagatcatcaacagacacagccctggacgcataaatttga

SEQ ID NO: 4331 - DNA, 50 bp, Homo sapiens
actaacgtatttcatcatggaaggtcctgtggtgatggttttccctggga

SEQ ID NO: 4332 - DNA, 50 bp, Homo sapiens
aagtaatagctccctgtttgtgccttgttagggctagggatgtttaagga

SEQ ID NO: 4333 - DNA, 50 bp, Homo sapiens
agctcctccccttagtgaccccaagtctgtttccctcagctgcataagga

SEQ ID NO: 4334 - DNA, 50 bp, Homo sapiens
ccctcaaatctcccaatctactccagggaaaagacacttcaagtgagaga

SEQ ID NO: 4335 - DNA, 50 bp, Homo sapiens
acatgcaaacagtgacttacttagtgcttctgaaaaatttctgagtcaga

SEQ ID NO: 4336 - DNA, 50 bp, Homo sapiens
aatgcccattggtaagtcaacattgttttccctgaaagtcctgagacaga

SEQ ID NO: 4337 - DNA, 50 bp, Homo sapiens
ccatgtttgctgctgctgttgagtttctgtgctttgggagtataataaga

SEQ ID NO: 4338 - DNA, 50 bp, Homo sapiens
tgtgtttggttgggtgtaatgaggaaaatacctgataaaatgtctgaaga

SEQ ID NO: 4339 - DNA, 50 bp, Homo sapiens
tggataagtgaagacagtaataacattgaagcagtgaaccagtggaaaga

SEQ ID NO: 4340 - DNA, 50 bp, Homo sapiens
agcacaaaaatgttgaagtattaggcccaagctccatgtttggttagtca

SEQ ID NO: 4341 - DNA, 50 bp, Homo sapiens
cgtttaacaataataaaggtgactgcttcatctaaggaatccgagccgca

SEQ ID NO: 4342 - DNA, 50 bp, Homo sapiens
gggcattccaccgaaattcttggggaaatttagtagccttcattttagca

SEQ ID NO: 4343 - DNA, 50 bp, Homo sapiens
tccatgttctgtgcaagaaggagacacattttcagttgaggttcccagca

SEQ ID NO: 4344 - DNA, 50 bp, Homo sapiens
agctcaacactgtggtaggaaaatagccactagaaagaaaataaaaagca

SEQ ID NO: 4345 - DNA, 50 bp, Homo sapiens
gcatctccagggtttagcatcaggacagaggattaagtaaattctttcca

SEQ ID NO: 4346 - DNA, 50 bp, Homo sapiens
gagactacagagccttagcccctttaaagcccttaaagttactacttcca

SEQ ID NO: 4347 - DNA, 50 bp, Homo sapiens
agagcaagtctcagaaataatgctgtatctacactgtcatgtatttgcca

SEQ ID NO: 4348 - DNA, 50 bp, Homo sapiens
tggttctctgatttgtaatgagcacctggatatgtcaattaaaatgccca

SEQ ID NO: 4349 - DNA, 50 bp, Homo sapiens
gcaagactgttcagtattatgttagcattgatataaaaagaagcagacca

SEQ ID NO: 4350 - DNA, 50 bp, Homo sapiens
aatgttcccaaaggccaaatttgttgccaggttttatacgcaggtcacca

SEQ ID NO: 4351 - DNA, 50 bp, Homo sapiens
tgcctattgtgattatcgctatcactacatcccctgactaagggaaacca

SEQ ID NO: 4352 - DNA, 50 bp, Homo sapiens
acaaaattcactgcaggtcggtggaatgatagaatgcattttaaatcaca

SEQ ID NO: 4353 - DNA, 50 bp, Homo sapiens
ggacggttggctgaatggcaacagtgatggaatatttatatttagccaca

SEQ ID NO: 4354 - DNA, 50 bp, Homo sapiens
acattgcacatttaatagctgcaccagacactaagagttcctctcacaca

SEQ ID NO: 4355 - DNA, 50 bp, Homo sapiens
cgcttgtcctgtgagtagctcgtcacctgaggccttgtcgtgaatattaa

SEQ ID NO: 4356 - DNA, 50 bp, Homo sapiens
tggagcaaaccacagtttcatgcccatcgtcctagaattaattcccctaa

SEQ ID NO: 4357 - DNA, 50 bp, Homo sapiens
gggacaacacagtggatttgaaatctgaaggggcattggtggtactggaa

SEQ ID NO: 4358 - DNA, 50 bp, Homo sapiens
acctccatatcttctcgtacttgttcctgctggtctcttagctctccgaa

SEQ ID NO: 4359 - DNA, 50 bp, Homo sapiens
cgaggatggtttcctgatagctttcaaacacctttgccatctcttcgcaa

SEQ ID NO: 4360 - DNA, 50 bp, Homo sapiens
actcctgacagctcatcctgcaaaattaaaatccaaaatttaagtcgcaa

SEQ ID NO: 4361 - DNA, 50 bp, Homo sapiens
gctggatctctgcctaaagtcacggtaggatgagaagtagaaacgagcaa

SEQ ID NO: 4362 - DNA, 50 bp, Homo sapiens
tcagaccataggtgggtgttgtttcttttaagtgtgtgtactgtgtccaa

SEQ ID NO: 4363 - DNA, 50 bp, Homo sapiens
tcatctatgtagcttaatctcatcgacgtttcggttcatttcctgcacaa

SEQ ID NO: 4364 - DNA, 50 bp, Homo sapiens
ttccttttccgctaatcaagagtccagggaggtgggaacagcctcaacaa

SEQ ID NO: 4365 - DNA, 50 bp, Homo sapiens
ccggcagctgtgtttagcccctccagatggaagtttcacttgaatgtaaa

SEQ ID NO: 4366 - DNA, 50 bp, Homo sapiens
acaaaggaatgaagctttatgacagggcacgtgaaatgtttatagtgaaa

SEQ ID NO: 4367 - DNA, 50 bp, Homo sapiens
actaaaggtcacaacccattaacaaccatgaaattggtgttgggaagaaa

SEQ ID NO: 4368 - DNA, 50 bp, Homo sapiens
tgctcaggaaaccaaaaaggatgtctgcatggaggacaaaaaggcacaaa

SEQ ID NO: 4369 - DNA, 50 bp, Homo sapiens
tgagaaccgcgcaccctacccatcggccacgtgaccagtcctttttaaaa

SEQ ID NO: 4370 - DNA, 50 bp, Homo sapiens
gtctttgggtcagtgtcatcattctcttcaagtctggggcttggggaaaa

SEQ ID NO: 4371 - DNA, 50 bp, Homo sapiens
ctccacacaggagaatctcggcgatttacacccacaggctacgcagaaaa

SEQ ID NO: 4372 - DNA, 50 bp, Homo sapiens
gcgctgctcccaaaatctatctgctgtttaatagtttttacctttcaaaa

SEQ ID NO: 4373 - DNA, 50 bp, Homo sapiens
gggttcagggggttttccctttgcccgtttggccctgggtttaataaaaa

SEQ ID NO: 4374 - DNA, 50 bp, Homo sapiens
ccaactcctcacagggcaggctagcgggcaccaggtcgccggggaagtgg

SEQ ID NO: 4375 - DNA, 50 bp, Homo sapiens
cggctgagagcccggtagggcccaggggccaagcgcaggcagaggccgcg

SEQ ID NO: 4376 - DNA, 50 bp, Homo sapiens
cttggggtccagggcacagcggtgccggggacacagcagttccgagggtc

SEQ ID NO: 4377 - DNA, 50 bp, Homo sapiens
agtatggtaattagaaagcatgttagaacatgtggaaaaagggggaaaaa

SEQ ID NO: 4378 - DNA, 50 bp, Homo sapiens
catcagtcctcatcagctgaagtggcttcccaaggatttaaataaatagt

SEQ ID NO: 4379 - DNA, 50 bp, Homo sapiens
agacattgactacagggtaatttctatgattatattatttagaagtatga

SEQ ID NO: 4380 - DNA, 50 bp, Homo sapiens
ccagtgaactgttagcaacaatgcagaagaatctgcatgtaataaactga

SEQ ID NO: 4381 - DNA, 50 bp, Homo sapiens
acttaaatgccttttaatttttgtcgatgtaatagtttaataccagtaaa

SEQ ID NO: 4382 - DNA, 50 bp, Homo sapiens
tttttaattctagcttctttttaaagattatttgggtacctaataaagga

SEQ ID NO: 4383 - DNA, 50 bp, Homo sapiens
caaagcctccacaggagaccccacccagcagcccagcccctacccaggag

SEQ ID NO: 4384 - DNA, 50 bp, Homo sapiens
cgagtgacattggctgacatcacagttgtctgaacctgttgtggctctat

SEQ ID NO: 4385 - DNA, 50 bp, Homo sapiens
tgaattgcttcaaaacctcttccatctcagaagaccagaccctgggaact

SEQ ID NO: 4386 - DNA, 50 bp, Homo sapiens
gctgaagtggcaatagagagagtctgctagaaagacggaagtcaccatct

SEQ ID NO: 4387 - DNA, 50 bp, Homo sapiens
tctactgactatcctagaaatcgctgtcgccttaatccaagcctacgttt

SEQ ID NO: 4388 - DNA, 50 bp, Homo sapiens
gtgtgtgcttagccaaatacagtaactgtgactggcccagggatgttctc

SEQ ID NO: 4389 - DNA, 50 bp, Homo sapiens
gtgagtccaatgtatgctttagaagtaaagacattgaccgtcacagacca

SEQ ID NO: 4390 - DNA, 50 bp, Homo sapiens
ctcaagaaaagacagaagagacagtgatttgggatgagtctactctagga

SEQ ID NO: 4391 - DNA, 50 bp, Homo sapiens
accctatgcccattgtcctgatctgaaaattcttggaaattgttccatgt

SEQ ID NO: 4392 - DNA, 50 bp, Homo sapiens
ttcacagtcttctattgttggaccacttacattgtaccaaatgttttcct

SEQ ID NO: 4393 - DNA, 50 bp, Homo sapiens
attaagcccccgtagcccatcccgcaagttagatacagctatggttaagg

SEQ ID NO: 4394 - DNA, 50 bp, Homo sapiens
ttatattgtagtggtggtatttgctttccgcctgttggctacttcgaccc

SEQ ID NO: 4395 - DNA, 50 bp, Homo sapiens
ttgttctctgtcatgcccacaatccctttctaaggaagactgccctacta

SEQ ID NO: 4396 - DNA, 50 bp, Homo sapiens
actgaggacgaggctgactactactgtcagtcttatgatagcacctatca

SEQ ID NO: 4397 - DNA, 50 bp, Homo sapiens
agatggaggatgaagctgactactactgttactcaacagacagcagtggt

SEQ ID NO: 4398 - DNA, 50 bp, Homo sapiens
catgtcaatgtgtctgttgtcatggcggaggtggacggcacctgctactg

SEQ ID NO: 4399 - DNA, 50 bp, Homo sapiens
gtcaatgtgtctgttgtcatggcggaggtggacggcacctgctactgagc

SEQ ID NO: 4400 - DNA, 50 bp, Homo sapiens
tccaacctccagtttgaggatgaggctgattattactgtgagacctggga

SEQ ID NO: 4401 - DNA, 50 bp, Homo sapiens
gactacaactggcaatcccaactcctgggctagggctttttctacctttt

SEQ ID NO: 4402 - DNA, 50 bp, Homo sapiens
tatttctgtgcgagagttccccctaaacatggcggaggcttcttctacaa

SEQ ID NO: 4403 - DNA, 50 bp, Homo sapiens
tggctaggagaccttgggcagtacctacagtcttgctgtttctgtttcat

SEQ ID NO: 4404 - DNA, 50 bp, Homo sapiens
gtgagctgaacaaatacatcatttaaatctatgctgcactttgagttgct

SEQ ID NO: 4405 - DNA, 50 bp, Homo sapiens
cccgtgtgtttacagcatttccaggtccagagaggttggcagacaagtgc

SEQ ID NO: 4406 - DNA, 50 bp, Homo sapiens
agctgtgggatataagtagtggtcattatgtcttcggaggtggcaccact

SEQ ID NO: 4407 - DNA, 50 bp, Homo sapiens
gccctttgagaaagactttgttcctgaactgctcccttctcttttagggt

SEQ ID NO: 4408 - DNA, 50 bp, Homo sapiens
ggtctggttctagatcagccttttcagtctgccctggcctggtcattaat

SEQ ID NO: 4409 - DNA, 50 bp, Homo sapiens
gaaaaacctggctagagcagagcacaggatgtaaaagggtgggggagaac

SEQ ID NO: 4410 - DNA, 50 bp, Homo sapiens
ggttatctgagcataacagggacagggtgggccacaggatacctctgagg

SEQ ID NO: 4411 - DNA, 50 bp, Homo sapiens
acaagcaggagcacatcgctcttttatgaaagcccttcaacatttaacgt

SEQ ID NO: 4412 - DNA, 50 bp, Homo sapiens
cagggacaccacttatcctgcttccactatagcatgaatcagtgctctct

SEQ ID NO: 4413 - DNA, 50 bp, Homo sapiens
catcgcacacgaatttgaatcatctgctctttggaatcgcctacaccctg

SEQ ID NO: 4414 - DNA, 50 bp, Homo sapiens
tgtatgtaggtgtctgagcttcacaagccttttatagtccattcagcact

SEQ ID NO: 4415 - DNA, 50 bp, Homo sapiens
cgacgacaacggtgtatattattgtgcgaaagatcgggcagatttgactt

SEQ ID NO: 4416 - DNA, 50 bp, Homo sapiens
cggtgagactcagtgaaagccatcagcaaaactacagtaatgcggcacta

SEQ ID NO: 4417 - DNA, 50 bp, Homo sapiens
aagttaaacaagactctgaaagccctaaatcaactagtccgtcggctgca

SEQ ID NO: 4418 - DNA, 50 bp, Homo sapiens
cttgagtggtcctcttctgcctgctgctcatttgtcttgggcaaccattt

SEQ ID NO: 4419 - DNA, 50 bp, Homo sapiens
cccaggaatatacagtacttctgtagtgtccagccattacttagcaaggg

SEQ ID NO: 4420 - DNA, 50 bp, Homo sapiens
tgctctgtctgctggtttgcattgtttctgtctgagttaagagactggca

SEQ ID NO: 4421 - DNA, 50 bp, Homo sapiens
ttcttttctccgttagccacgcagctacctactcccgcttccggttcaaa

SEQ ID NO: 4422 - DNA, 50 bp, Homo sapiens; identical to SEQ ID NO: 846

SEQ ID NO: 4423 - DNA, 50 bp, Homo sapiens
gatgaacagtctgagaggcgaggacacggccttgtttaactgtgcgagtc

SEQ ID NO: 4424 - DNA, 50 bp, Homo sapiens
tactacttgccaggtccaagaacggggcgggtcctgttatcattattaca

SEQ ID NO: 4425 - DNA, 50 bp, Homo sapiens
gctgtgtttttctgtgggtgaaataaaggtttcggagcccgttttagata

SEQ ID NO: 4426 - DNA, 50 bp, Homo sapiens
catttctgtgcgagagtgaagaggggaccctagaggatttcgttgtggga

SEQ ID NO: 4427 - DNA, 50 bp, Homo sapiens
ggactccaggctgaggacgaggctgattattagtgatgctcataaacaag

SEQ ID NO: 4428 - DNA, 50 bp, Homo sapiens
ctcttattgtgcgagagacctcccggaactgccactgaaggtggaggcta

SEQ ID NO: 4429 - DNA, 50 bp, Homo sapiens
ctccctgactatctcgggcctctagcctgaggacgaggctgattattatt

SEQ ID NO: 4430 - DNA, 50 bp, Homo sapiens
aagaactcactgtatctgcaaatgaacagcctgaaaaccgaggacacggc

SEQ ID NO: 4431 - DNA, 50 bp, Homo sapiens
cacggctgtgtttaactctgcgacatgcgggggactatggttcgggggaa

SEQ ID NO: 4432 - DNA, 50 bp, Homo sapiens
tcagggtgattgaaggacacatattgaagtacctagaatgccagaaagtg

SEQ ID NO: 4433 - DNA, 50 bp, Homo sapiens
aacaaaactgtgatttatatcaaataacaatggcttggagggggtatgga

SEQ ID NO: 4434 - DNA, 50 bp, Homo sapiens; identical to SEQ ID NO: 1036

SEQ ID NO: 4435 - DNA, 50 bp, Homo sapiens; identical to SEQ ID NO: 1036

SEQ ID NO: 4436 - DNA, 50 bp, Homo sapiens; identical to SEQ ID NO: 1036

SEQ ID NO: 4437 - DNA, 50 bp, Homo sapiens
tgtggctgtacttaaccttctccaacatacatcctgcattacatgaatgg

SEQ ID NO: 4438 - DNA, 50 bp, Homo sapiens
aagcctttgaagtgcctctgattctatgtaacttgttgcagactggtgtt

SEQ ID NO: 4439 - DNA, 50 bp, Homo sapiens
gcattgacctggaaggagagaagatagagagtggaggctctgaaggagac

SEQ ID NO: 4440 - DNA, 50 bp, Homo sapiens
cagtacagggctggcaagcagtgatctctcaggtatatttatcaataatt

SEQ ID NO: 4441 - DNA, 50 bp, Homo sapiens
caaaccctcctttctgcttgcctcaaacctgccaaatatacccacacttt

SEQ ID NO: 4442 - DNA, 50 bp, Homo sapiens; identical to SEQ ID NO: 562

SEQ ID NO: 4443 - DNA, 50 bp, Homo sapiens
agtgatttgattaactcagggcaaggctgaatatcagagtgtatcgcact

SEQ ID NO: 4444 - DNA, 50 bp, Homo sapiens
gcttccactggaggcttgtattgaccttgtaactatatgttaatctcgtg

SEQ ID NO: 4445 - DNA, 50 bp, Homo sapiens
atgcatgtttaccaaaatggctgtttacagtgcattcagttctgatattt

SEQ ID NO: 4446 - DNA, 50 bp, Homo sapiens
acatgacaggtgtaattagtctgctgagccagctttacccaatgaagggc

SEQ ID NO: 4447 - DNA, 50 bp, Homo sapiens
aacagcaaccaataacggattgtaaagtgtaaaggcacaggttactcatg

SEQ ID NO: 4448 - DNA, 50 bp, Homo sapiens
ccatgccaaggaatggaatttccatcctgagccagttcagttaggtgtca

SEQ ID NO: 4449 - DNA, 50 bp, Homo sapiens
ctagagttcatctctgagctgtaagggtgaccagggggcagggggacgat

SEQ ID NO: 4450 - DNA, 50 bp, Homo sapiens
caagtagacaccagagtcactgtttggttggtgggtgatagtggggtcac

SEQ ID NO: 4451 - DNA, 50 bp, Homo sapiens
tgtcacccttccatgacgcctcctctgtgcatttgagttcactgtttatg

SEQ ID NO: 4452 - DNA, 50 bp, Homo sapiens
ggtaacatgagctatggcagtcggttgtgaaaccacaggaagtgtatggg

SEQ ID NO: 4453 - DNA, 50 bp, Homo sapiens
caaatcgggcaccacctccttcagggcgcatgagaccatattaaattcta

SEQ ID NO: 4454 - DNA, 50 bp, Homo sapiens
cagaactgctttcctatgtttacccaggggacctcctttcagatgaactg

SEQ ID NO: 4455 - DNA, 50 bp, Homo sapiens
agcaataatatctctgttttcatttcagaacattgtgctgtctgtcagca

SEQ ID NO: 4456 - DNA, 50 bp, Homo sapiens
ttacaactacatgatgggcatcgagtttaacccttggatcgggaagtggg

SEQ ID NO: 4457 - DNA, 50 bp, Homo sapiens
aatgtttgagctgaccaagcttctgagattcttaacagaaaaagccatgt

SEQ ID NO: 4458 - DNA, 50 bp, Homo sapiens
acgtcagcttaaaactggaaagaagtcttctggtgtatactgagatttga

SEQ ID NO: 4459 - DNA, 50 bp, Homo sapiens
gcccaaaggagtagctctctgttgttactgttgtgctcttcatggataaa

SEQ ID NO: 4460 - DNA, 50 bp, Homo sapiens
gcaaaaagcccaagagcctgaatttagaccaatctatcatcttcctcctc

SEQ ID NO: 4461 - DNA, 50 bp, Homo sapiens
tggagatgtgataacaactccttatctctttgttggctcatctgaagtgt

SEQ ID NO: 4462 - DNA, 50 bp, Homo sapiens
cttgcagtaaaatgtagcccttcctcctggttgtgcaggagtggccctcg

SEQ ID NO: 4463 - DNA, 50 bp, Homo sapiens
tttctttagcccaagagtggaggctaagctacttacttccaagcctgggt

SEQ ID NO: 4464 - DNA, 50 bp, Homo sapiens
aggcaaagggaacttgaaattagaaaaccccagaaacagtcacaatggct

SEQ ID NO: 4465 - DNA, 50 bp, Homo sapiens
agggtcccttccatagtcctcctgcatcattttcctccaacttgaataaa

SEQ ID NO: 4466 - DNA, 50 bp, Homo sapiens
gccaaccagttcagagtgttcccaaggaattgccacccttactcttcaaa

SEQ ID NO: 4467 - DNA, 50 bp, Homo sapiens
atcccagtctcaaatttcttcatttggaactgatatgtaggccctcatcg

SEQ ID NO: 4468 - DNA, 50 bp, Homo sapiens
tctctcactgttatcatttttgcacaggtggtttcagcagcttgatgcca

SEQ ID NO: 4469 - DNA, 50 bp, Homo sapiens
attgtcatttagactttgaacagctctgggaaatagaagactagggttgt

SEQ ID NO: 4470 - DNA, 50 bp, Homo sapiens; identical to SEQ ID NO: 293

SEQ ID NO: 4471 - DNA, 50 bp, Homo sapiens
ggattcaccgtggccgactcttttccctgctttggtttgtttgaaatcta

SEQ ID NO: 4472 - DNA, 50 bp, Homo sapiens
ccctccacaccatcctccccgatttaaatatagtcactgctacaagtaac

SEQ ID NO: 4473 - DNA, 50 bp, Homo sapiens
ttcatcattgcttgcttgccttcctcccttctgtccgctcttactccctc

SEQ ID NO: 4474 - DNA, 50 bp, Homo sapiens
gcaaactaaccgtgtcaacggggtgagatgttgcatcttataaaattaga

SEQ ID NO: 4475 - DNA, 50 bp, Homo sapiens; identical to SEQ ID NO: 4474

SEQ ID NO: 4476 - DNA, 50 bp, Homo sapiens; identical to SEQ ID NO: 4474

SEQ ID NO: 4477 - DNA, 50 bp, Homo sapiens
agtatctgctttccaggctgaagtgattcattcattattctagtcctgct

SEQ ID NO: 4478 - DNA, 50 bp, Homo sapiens
aagctgtcttctttgttggacaatcagccagaatgataagcaaacctgca

SEQ ID NO: 4479 - DNA, 50 bp, Homo sapiens
ctctcgcggtcgcacgaggatgcttggcacgtaccccctgtacatacttc

SEQ ID NO: 4480 - DNA, 50 bp, Homo sapiens; identical to SEQ ID NO: 4479

SEQ ID NO: 4481 - DNA, 50 bp, Homo sapiens; identical to SEQ ID NO: 4479

SEQ ID NO: 4482 - DNA, 50 bp, Homo sapiens
ctcctgtggattcacatcaaataccagttcagttttgtcattgttctagt

SEQ ID NO: 4483 - DNA, 50 bp, Homo sapiens
ggctcctgattacgatgctttggatgttgccaacaaaattgggatcatct

SEQ ID NO: 4484 - DNA, 50 bp, Homo sapiens
aacgccagcattttgttagaggagttagacttggaaaagttaagggaaga

SEQ ID NO: 4485 - DNA, 50 bp, Homo sapiens
atggggactaagggattaagagtgtgaactaaaaggtaacattttccact

SEQ ID NO: 4486 - DNA, 50 bp, Homo sapiens
actggcgagtatgttctatgttgggcctcctgctgcaaaacaataaacag

SEQ ID NO: 4487 - DNA, 50 bp, Homo sapiens
gctgattaactgtattcccctttcccctatggctgctggtgtaaataaac

SEQ ID NO: 4488 - DNA, 50 bp, Homo sapiens
cccagggtttcatgtctgaggccctcaccaagtgtgagtgacagtataaa

SEQ ID NO: 4489 - DNA, 50 bp, Homo sapiens; identical to SEQ ID NO: 4488

SEQ ID NO: 4490 - DNA, 50 bp, Homo sapiens; identical to SEQ ID NO: 4063

SEQ ID NO: 4491 - DNA, 50 bp, Homo sapiens
acacctctctattttgaagtccctatgtgccctgtaatgtctcgttttaa

SEQ ID NO: 4492 - DNA, 50 bp, Homo sapiens
gggagagctcatgtcagtgaatatagatcattctgttgatacccttcttt

SEQ ID NO: 4493 - DNA, 50 bp, Homo sapiens
ttgaaacttgtaactgagatgctgtagttttttgccatctgtagtgatgt

SEQ ID NO: 4494 - DNA, 50 bp, Homo sapiens
aaagggttttatccactgtcatttcaattggataacattttgtcaagttt

SEQ ID NO: 4495 - DNA, 50 bp, Homo sapiens
tcggaaagaagaagtgggaggatgtgaattttagttctgagtttaccaaa

SEQ ID NO: 4496 - DNA, 50 bp, Homo sapiens
gatcgggaactggctccgttgtgctgaggtcatctttggtcatcagcctc

SEQ ID NO: 4497 - DNA, 50 bp, Homo sapiens
tggtgcttgtgcagcctggcagttcattgtcatctttaataaactaagga

SEQ ID NO: 4498 - DNA, 50 bp, Homo sapiens
agaagtacaagatttcgttcttccttccattaaagtacaatctccctggg

SEQ ID NO: 4499 - DNA, 50 bp, Homo sapiens
tacaagtgaaagctaagatgaacacatttaagttaaatggcagccttgtt

SEQ ID NO: 4500 - DNA, 50 bp, Homo sapiens
aaaaggatgtgacagaagcagagatgaccagaaagcacaggggcagggtt

SEQ ID NO: 4501 - DNA, 50 bp, Homo sapiens
gggttttctataaggggtttcctgctgaacaggggcgtgggattgaatta

SEQ ID NO: 4502 - DNA, 50 bp, Homo sapiens
cctgggaccagggcatattaaaggcttttggcagcaaagtgtcagtgttg

SEQ ID NO: 4503 - DNA, 50 bp, Homo sapiens
tttgtggcttggggctgcctactataaactattgggggttcgtccatttt

SEQ ID NO: 4504 - DNA, 50 bp, Homo sapiens; identical to SEQ ID NO: 746

SEQ ID NO: 4505 - DNA, 50 bp, Homo sapiens
aattcctgaaccgttggatcaccttctgtcagtccatcatctccaccctg

SEQ ID NO: 4506 - DNA, 50 bp, Homo sapiens
cttacgttgggacacctaaattcgccgcgtctgtagaaggcagattcgag

SEQ ID NO: 4507 - DNA, 50 bp, Homo sapiens
aaaaccgtgtctgtcccttcaacagagtcatcgaggaggggtggctgcta

SEQ ID NO: 4508 - DNA, 50 bp, Homo sapiens
aaactgccgggtccccatcttcaaaagagaggaggccctttctccagctt

SEQ ID NO: 4509 - DNA, 50 bp, Homo sapiens
caagaaagcaacttgagccttgggctaatctggctgagtagtcagttata

SEQ ID NO: 4510 - DNA, 50 bp, Homo sapiens
tgtgttctttgagttccccctttacccaaaagtaatttggggaccaaagt

SEQ ID NO: 4511 - DNA, 50 bp, Homo sapiens
gggaaggcaatctgatggggaagttggcaatttctggtttgggtgattta

SEQ ID NO: 4512 - DNA, 50 bp, Homo sapiens
ccagccgtcctcctggggtggaccctagtttaataaagattcaccaagtt

SEQ ID NO: 4513 - DNA, 50 bp, Homo sapiens
catgcaagggcaaaaggcagtgccatgcaagctgtttaaaataaagatgt

SEQ ID NO: 4514 - DNA, 50 bp, Homo sapiens
aggggtgggaggaagcaaaagactctgtacctattttgtatgtgtataat

SEQ ID NO: 4515 - DNA, 50 bp, Homo sapiens
tcaggatgtgagcactcgttgtgtctggatgttacaaatatgggtggttt

SEQ ID NO: 4516 - DNA, 50 bp, Homo sapiens
tgttcacgttgttcacatcccatgtagaaaaacaaagatgccacggagga

SEQ ID NO: 4517 - DNA, 50 bp, Homo sapiens
agccctgcaaaaattcagagtccttgcaaaattgtctaaaatgtcagtgt

SEQ ID NO: 4518 - DNA, 50 bp, Homo sapiens
tgtcatctcaagtcaagtcactggtctgtttgcatttgatacatttttgt

SEQ ID NO: 4519 - DNA, 50 bp, Homo sapiens
gagtgaccacagggatgccacacagctcggatttcagcctctgatgtcag

SEQ ID NO: 4520 - DNA, 50 bp, Homo sapiens
gcctgttgccctttctgtaccatttatttgctcccaatgtttatgataat

SEQ ID NO: 4521 - DNA, 50 bp, Homo sapiens; identical to SEQ ID NO: 4520

SEQ ID NO: 4522 - DNA, 50 bp, Homo sapiens
tcctggatgcctctgaagagagggacagaccgtcagaaactggagagttt

SEQ ID NO: 4523 - DNA, 50 bp, Homo sapiens
acttaaccatataaatgtggaggctatcaacaaagaatgggcttgaaaca

SEQ ID NO: 4524 - DNA, 50 bp, Homo sapiens; identical to SEQ ID NO: 1933

SEQ ID NO: 4525 - DNA, 50 bp, Homo sapiens
aaacagacctaatgctccttgttcctagagtagagtggagggagggtggc

SEQ ID NO: 4526 - DNA, 50 bp, Homo sapiens
gagatagccttgctccggcccccttgaccttcagcaaatcacttctctcc

SEQ ID NO: 4527 - DNA, 50 bp, Homo sapiens
ctgctgcgtctcccttccaaactctggtgctgaataaacccttctgatct

SEQ ID NO: 4528 - DNA, 50 bp, Homo sapiens
cacttggctgcataaatgtggtacaaccattctgtcttgaagggcaggtg

SEQ ID NO: 4529 - DNA, 50 bp, Homo sapiens
cagccaatggacacagtagggcttggtgaatgctgctgagtgaatgagta

SEQ ID NO: 4530 - DNA, 50 bp, Homo sapiens
tgcagaggattgaggcttaattctgagctggccctttccagccaataaat

SEQ ID NO: 4531 - DNA, 50 bp, Homo sapiens
ttgaccttccactagaccatgagcacctgggcggaaagccatatatctta

SEQ ID NO: 4532 - DNA, 50 bp, Homo sapiens
acaagcagacacctgaaacaatcaacgcccaataaaacaaagtaggatga

SEQ ID NO: 4533 - DNA, 50 bp, Homo sapiens
tgaggaagaaagcattttgcatcagcctggagtgaaccatgaacttggat

SEQ ID NO: 4534 - DNA, 50 bp, Homo sapiens
ggaataaggtgttgcctggaatttctggtttgtaaggtggtcactgttct

SEQ ID NO: 4535 - DNA, 50 bp, Homo sapiens
tgaacagatggattaccttttgtcaaagcatcatctcaacactaacttga

SEQ ID NO: 4536 - DNA, 50 bp, Homo sapiens
cccagagttttcagggagtacacaggtagattagtttgaagcattgacct

SEQ ID NO: 4537 - DNA, 50 bp, Homo sapiens; identical to SEQ ID NO: 280

SEQ ID NO: 4538 - DNA, 50 bp, Homo sapiens
ggctgccccagaggacagtgggtggagtggtacctacttattaaatgtct

SEQ ID NO: 4539 - DNA, 50 bp, Homo sapiens
ccgagcaaagatcaaaataaaaagtgacacagcagcttcaccagagcatt

SEQ ID NO: 4540 - DNA, 50 bp, Homo sapiens
tttccttcaagcctagcccttctctcattatttctctctgaccctctccc

SEQ ID NO: 4541 - DNA, 50 bp, Homo sapiens
gggtcagtgttcaagaaggaaagcagttgttgaagctacagaagcccagg

SEQ ID NO: 4542 - DNA, 50 bp, Homo sapiens
tgaagactttccatatcaagagacatggtattgactcaacagtttccagt

SEQ ID NO: 4543 - DNA, 50 bp, Homo sapiens
ggactgtcattcagggaggctaaggagagaggcttgcttgggatatagaa

SEQ ID NO: 4544 - DNA, 50 bp, Homo sapiens
tcacttaaccccaggccattatcatatccagatggtcttcagagttgtct

SEQ ID NO: 4545 - DNA, 50 bp, Homo sapiens
ccactggatggtcatttggcatctccgtatatgtgctctggctcctcagc

SEQ ID NO: 4546 - DNA, 50 bp, Homo sapiens
ctgggccacactgaccctgatacaggcatggcagaagaatgggaatattt

SEQ ID NO: 4547 - DNA, 50 bp, Homo sapiens; identical to SEQ ID NO: 4546

SEQ ID NO: 4548 - DNA, 50 bp, Homo sapiens
tgatagcattggtcttgacaagcaccatagtgacactgaaatggattggt

SEQ ID NO: 4549 - DNA, 50 bp, Homo sapiens
ctgaggatgtagagagaacaggtgggctgtattcacgccattggttggaa

SEQ ID NO: 4550 - DNA, 50 bp, Homo sapiens; identical to SEQ ID NO: 2058

SEQ ID NO: 4551 - DNA, 50 bp, Homo sapiens
tggtccaaaggcaaagttcgggacaagctcaataacttagtcttgtttga

SEQ ID NO: 4552 - DNA, 50 bp, Homo sapiens
caacaggtgtcacactaaggagactttgttcatggctggggacacagccc

SEQ ID NO: 4553 - DNA, 50 bp, Homo sapiens
gcatggaaattcccttcatctggaaccatcagaaacaccctcacactggg

SEQ ID NO: 4554 - DNA, 50 bp, Homo sapiens
ggcagctatggtcaaattgagaaaggtagtgtataaatgtgacaaagaca

SEQ ID NO: 4555 - DNA, 50 bp, Homo sapiens
gctatcttgtctggttttcttgagacctcagatgtgtgttcagcagggct

SEQ ID NO: 4556 - DNA, 50 bp, Homo sapiens
ccgccctgtaccctctttcacctttccctaaagaccctaaatctgaggaa

SEQ ID NO: 4557 - DNA, 50 bp, Homo sapiens
catatgggagaaggccagtgcccaggcatagggttagctcagtttccctc

SEQ ID NO: 4558 - DNA, 50 bp, Homo sapiens
ttaataccaggaacccagcggctctagccactgagcggctaaatgaaata

SEQ ID NO: 4559 - DNA, 50 bp, Homo sapiens
gtggaggggtttaccaccttcctaggtcgttcaaccaggttttgtgagga

SEQ ID NO: 4560 - DNA, 50 bp, Homo sapiens
gcaacccttcagaaaggctttgctcctgctctcagatcagatcaagcatt

SEQ ID NO: 4561 - DNA, 50 bp, Homo sapiens
aacatttggaggaaggtgggaagcagatgactgaggaagggatggactaa

SEQ ID NO: 4562 - DNA, 50 bp, Homo sapiens
tgcccagaaagctcagaaggctaaatgaatattatccctaatacctgcca

SEQ ID NO: 4563 - DNA, 50 bp, Homo sapiens
agaggactcttcgagacattgagaccttctacaacacctccattgaggaa

SEQ ID NO: 4564 - DNA, 50 bp, Homo sapiens; identical to SEQ ID NO: 2128

SEQ ID NO: 4565 - DNA, 50 bp, Homo sapiens
aaactaaaacttcatcttccccaagtgcggggagtacaaggcatggcgta

SEQ ID NO: 4566 - DNA, 50 bp, Homo sapiens
aaaaccttcccataaaatgtaagaaaagctgatgaggctggtgacgttca

SEQ ID NO: 4567 - DNA, 50 bp, Homo sapiens; identical to SEQ ID NO: 641

SEQ ID NO: 4568 - DNA, 50 bp, Homo sapiens
gccacaaaatgttctttgttctttggctccaaaaagactgtcagctttca

SEQ ID NO: 4569 - DNA, 50 bp, Homo sapiens
ctgaggctctccctttctctgtgattggacagttgacagcacccaaactc

SEQ ID NO: 4570 - DNA, 50 bp, Homo sapiens
ccctgtaactcctcactgtactgatttactggcgcatgaaattctattaa

SEQ ID NO: 4571 - DNA, 50 bp, Homo sapiens
cttgagtaaaataaatattgtctttttgtatgtcaagcgggccgccaccg

SEQ ID NO: 4572 - DNA, 50 bp, Homo sapiens
gggagggagggagggaaagcttcctcctaaatcaagcatctttctgttac

SEQ ID NO: 4573 - DNA, 50 bp, Homo sapiens
tcacagatgcatatagacacacatacataatggtactcccaaactgacaa

SEQ ID NO: 4574 - DNA, 50 bp, Homo sapiens
gctgaggactcccgccatgtggccccaggtgccaccaataaaaatcctac

SEQ ID NO: 4575 - DNA, 50 bp, Homo sapiens
caagatgaggatttgggttttctataaggggtttcctgctggacaggggc

SEQ ID NO: 4576 - DNA, 50 bp, Homo sapiens
aaacatggcctttgcttgaaagaaaataccaaggaacaggaaactgatca

SEQ ID NO: 4577 - DNA, 50 bp, Homo sapiens; identical to SEQ ID NO: 52

SEQ ID NO: 4578 - DNA, 50 bp, Homo sapiens
ggaccaaaggctgattcttggagatttaactccccacaggcaatgggttt

SEQ ID NO: 4579 - DNA, 50 bp, Homo sapiens
aatatttgtttaatccccagttcgcctggagccctccgccttcacattcc

SEQ ID NO: 4580 - DNA, 50 bp, Homo sapiens
aaagtaactggttgtcacctatgagacccttacgtgattgttagttaagt

SEQ ID NO: 4581 - DNA, 50 bp, Homo sapiens
ctcagcctcctcatctgggggagtggaatagtatcctccaggtttttcaa

SEQ ID NO: 4582 - DNA, 50 bp, Homo sapiens
ggcaggaggttctcactgttgtgaaggttgtagacgttgtgtaatgtgtt

SEQ ID NO: 4583 - DNA, 50 bp, Homo sapiens
aagtgggaattttctggaagatggtcagctatgaagtaatagagtttgct

SEQ ID NO: 4584 - DNA, 50 bp, Homo sapiens
gcctgtggcccacctggggtcacttggaaaggatctgaataaaggggacc

SEQ ID NO: 4585 - DNA, 50 bp, Homo sapiens
aaataactggctcccagggtggcggtggtggcagcagtgatcctctgaac

SEQ ID NO: 4586 - DNA, 50 bp, Homo sapiens
tgcccacacccacactctccagcatctggcacaataaacattctctgttt

SEQ ID NO: 4587 - DNA, 50 bp, Homo sapiens; identical to SEQ ID NO: 4586

SEQ ID NO: 4588 - DNA, 50 bp, Homo sapiens
gcacccacctttctgcacataagttatggttttccatcttatctgtcttc

SEQ ID NO: 4589 - DNA, 50 bp, Homo sapiens
aattgtcaaacacagcttgcaatatacatagaaacgtctgtgctcaagga

SEQ ID NO: 4590 - DNA, 50 bp, Homo sapiens
tccagaaacatgacaaggaggactttcctgcctcttggagatcagaggag

SEQ ID NO: 4591 - DNA, 50 bp, Homo sapiens
tcatagttaaatttggtattcgtgggggaagaaatgaccatttcccttgt

SEQ ID NO: 4592 - DNA, 50 bp, Homo sapiens
acacacattcttgctctacccaaagctctggctggcagcactaaatgctt

SEQ ID NO: 4593 - DNA, 50 bp, Homo sapiens; identical to SEQ ID NO: 4592

SEQ ID NO: 4594 - DNA, 50 bp, Homo sapiens
gcagtctccacagtcttcagaagacaaatgctcaggtagtcactgtttcc

SEQ ID NO: 4595 - DNA, 50 bp, Homo sapiens
gcctcccgtgcatctgtactcaccctgtacgacaaacacattacattatt

SEQ ID NO: 4596 - DNA, 50 bp, Homo sapiens
tttcctgttccagaaaaggggctgggatgtctccgtctctgtctcaaatt

SEQ ID NO: 4597 - DNA, 50 bp, Homo sapiens
cggccttctccggtgtcctgtaccaactcttctatttaagagaacctcag

SEQ ID NO: 4598 - DNA, 50 bp, Homo sapiens
gggacgttccatgcccaggttaacaaagaactgtgatatatagagtgtct

SEQ ID NO: 4599 - DNA, 50 bp, Homo sapiens
atgggagatgcctgtgtaatttcgtccgaagctgccaggaagaagaacag

SEQ ID NO: 4600 - DNA, 50 bp, Homo sapiens
cctctccattgaaggattcaggaagaagaaaactcaactcagtgccattt

SEQ ID NO: 4601 - DNA, 50 bp, Homo sapiens
cctcaccttggcaccagacacccaggacttatttaaactctgttgcaagt

SEQ ID NO: 4602 - DNA, 50 bp, Homo sapiens
tgcaaatgtgagtttcctctcctgtccgtgtttgtttagtacttttataa

SEQ ID NO: 4603 - DNA, 50 bp, Homo sapiens
agcaggaattggtggcagattttacaaaagatgtatccttccaatttgga

SEQ ID NO: 4604 - DNA, 50 bp, Homo sapiens
tggatctgccaaaaagaactaacacctgtgagaaataaagtgtatcctga

SEQ ID NO: 4605 - DNA, 50 bp, Homo sapiens
ttcctgtactattgtgttttgagtgtgttttggaaccttcatagaacaca

SEQ ID NO: 4606 - DNA, 50 bp, Homo sapiens
tgacccacttaccttgcatctcacaggtagacagtatataactaacaacc

SEQ ID NO: 4607 - DNA, 50 bp, Homo sapiens; identical to SEQ ID NO: 2312

SEQ ID NO: 4608 - DNA, 50 bp, Homo sapiens
cacgagagtgaagagtgagccagcccttctggagcaggagcaggacagaa

SEQ ID NO: 4609 - DNA, 50 bp, Homo sapiens
aagaaaggcacaaaatgtgctatttttggtcacttgctttatgacgttta

SEQ ID NO: 4610 - DNA, 50 bp, Homo sapiens
gtccctggacacagctcttcattccattgacttagaggcaacaggattga

SEQ ID NO: 4611 - DNA, 50 bp, Homo sapiens
gtaccagctctccaacacggaggcaatcgactgcatcacgcagggacgtg

SEQ ID NO: 4612 - DNA, 50 bp, Homo sapiens
gggggctagttctctcctcacttgtaaacttgtgtagtttcacagaaaaa

SEQ ID NO: 4613 - DNA, 50 bp, Homo sapiens
acagaagaatttgtgtggaagcaggatgtaacagatacaccgtaaaggca

SEQ ID NO: 4614 - DNA, 50 bp, Homo sapiens; identical to SEQ ID NO: 2339

SEQ ID NO: 4615 - DNA, 50 bp, Homo sapiens
cttgaaggaagagggaccagggtgggagagctgattgcagaaaggagaga

SEQ ID NO: 4616 - DNA, 50 bp, Homo sapiens
aaaccattaaagtatacagagaggatgacacagccacagaagaaactcat

SEQ ID NO: 4617 - DNA, 50 bp, Homo sapiens
aacatgcacaaagcagttaattaggcagcctggagaaaaccagagatcca

SEQ ID NO: 4618 - DNA, 50 bp, Homo sapiens
acttccagaaactcatcaaatgaacagacaatgtcaaaactactgtgtct

SEQ ID NO: 4619 - DNA, 50 bp, Homo sapiens
gctttatgggtttggcttgtttttcttgcatggtttggagctgatcgctt

SEQ ID NO: 4620 - DNA, 50 bp, Homo sapiens
ttctttcttggcctcaagttcaatatggagaggattgcttccctgaatcc

SEQ ID NO: 4621 - DNA, 50 bp, Homo sapiens
aactatgtggactggattaaggacaccatagctgccaacagctaaagccc

SEQ ID NO: 4622 - DNA, 50 bp, Homo sapiens
cctgacttcttcacgcgggtagccctctacgtggactggatccgttctac

SEQ ID NO: 4623 - DNA, 50 bp, Homo sapiens
agccagcaggacatgaagttgctattaaatggacttcgtgatttttgttt

SEQ ID NO: 4624 - DNA, 50 bp, Homo sapiens; identical to SEQ ID NO: 2383

SEQ ID NO: 4625 - DNA, 50 bp, Homo sapiens
aacttgtgccacaagagttacaatcaaagtggtctccttagactgaattc

SEQ ID NO: 4626 - DNA, 50 bp, Homo sapiens
aaagcctttaaaaacggctgtcaggtttgatctcagtgtaacaacatggc

SEQ ID NO: 4627 - DNA, 50 bp, Homo sapiens
gaaaatgcgccttaggctgagccaacatgactgtcccccaaactccagtg

SEQ ID NO: 4628 - DNA, 50 bp, Homo sapiens
ccagcttcggttccttccacctcatccggctgctctacgacgagtacatg

SEQ ID NO: 4629 - DNA, 50 bp, Homo sapiens
aagattggtgctcctgataaagcaaagggctaggaatacaatggaaagga

SEQ ID NO: 4630 - DNA, 50 bp, Homo sapiens
tcattggtacacattctgtatgctgctgttttcaagttggcaaattaagc

SEQ ID NO: 4631 - DNA, 50 bp, Homo sapiens
tatcagcaactgtcctcatcagtctccataccccttcagctttcctgagc

SEQ ID NO: 4632 - DNA, 50 bp, Homo sapiens
gcagcttggagaaggcgcaatactccagctccaccgttaccgctaatata

SEQ ID NO: 4633 - DNA, 50 bp, Homo sapiens; identical to SEQ ID NO: 4632

SEQ ID NO: 4634 - DNA, 50 bp, Homo sapiens
cggagcctcaaacaagcattataccttctgtgattatgatttcctctcct

SEQ ID NO: 4635 - DNA, 50 bp, Homo sapiens
atgtttcttggggaatatgttagagaattcccttactcttgattgtggga

SEQ ID NO: 4636 - DNA, 50 bp, Homo sapiens
agagtgatagtcttttgcttttggcaaaactctacttaatccaatgggtt

SEQ ID NO: 4637 - DNA, 50 bp, Homo sapiens
gcctcttgcttggcgtgataaccctgtcatcttcccaaagctcatttatg

SEQ ID NO: 4638 - DNA, 50 bp, Homo sapiens
ttcaactgaccagtcgtggttactccctgctgccaggtccttccccttcc

SEQ ID NO: 4639 - DNA, 50 bp, Homo sapiens
ggctggcacctctcaacgtctgtggactgaatgaataaaccctcctcatc

SEQ ID NO: 4640 - DNA, 50 bp, Homo sapiens
tgggaataacgtccaaaacactctggatcttatatggagaatgacattga

SEQ ID NO: 4641 - DNA, 50 bp, Homo sapiens
agtactgaactcagttccatccgtaaaatatgtaaaggtaagtggcagct

SEQ ID NO: 4642 - DNA, 50 bp, Homo sapiens
gcccaacttcatttccatacttcagggaacagcaaattgaggatttactt

SEQ ID NO: 4643 - DNA, 50 bp, Homo sapiens
ccgttgaatgagtgtgttttgtacataacttcagatacttgtgaacatgc

SEQ ID NO: 4644 - DNA, 50 bp, Homo sapiens
tttcttgggagagtcactccagccctgaagtctgtctctagctcctctgt

SEQ ID NO: 4645 - DNA, 50 bp, Homo sapiens; identical to SEQ ID NO: 2514

SEQ ID NO: 4646 - DNA, 50 bp, Homo sapiens
ttaggagtgattactaattatcaagggcacagttgtggtactgtcattga

SEQ ID NO: 4647 - DNA, 50 bp, Homo sapiens
cggacggaaggacggaaaaagctctatttttatgttaggcttatttcatg

SEQ ID NO: 4648 - DNA, 50 bp, Homo sapiens
agtccctgacagcctagaaataagctgtttgtcttctataaagcattgct

SEQ ID NO: 4649 - DNA, 50 bp, Homo sapiens
gcattttctgcctatgctggaatagctccctcttctggtcctggctcagg

SEQ ID NO: 4650 - DNA, 50 bp, Homo sapiens
agtaagggcacgtagagcatttagagttgtctttcagcattcaatcaggc

SEQ ID NO: 4651 - DNA, 50 bp, Homo sapiens
tgggtcttcagccttacccggaaatacttgtggtttctagatcaccatct

SEQ ID NO: 4652 - DNA, 50 bp, Homo sapiens
acaaggctgacaccaacagagatcgtattgatattgccaatgccagagca

SEQ ID NO: 4653 - DNA, 50 bp, Homo sapiens
agctacttctgccttatggctagggaactgtcatgtctaccatgtattgt

SEQ ID NO: 4654 - DNA, 50 bp, Homo sapiens
tgacttgttttgctccatgtctcctcattcctacacctattttctgctgc

SEQ ID NO: 4655 - DNA, 50 bp, Homo sapiens
ctgtgaaaccgtcagttcggaaggctggttagaacatgtgggagcaacat

SEQ ID NO: 4656 - DNA, 50 bp, Homo sapiens
gcctagtgtgtgtgctttcttaatgtgtgtgccaatggtggatctttgct

SEQ ID NO: 4657 - DNA, 50 bp, Homo sapiens
accaaactggactctcgtgcagaaaatgtagcccattaccacatgtagcc

SEQ ID NO: 4658 - DNA, 50 bp, Homo sapiens; identical to SEQ ID NO: 2585

SEQ ID NO: 4659 - DNA, 50 bp, Homo sapiens; identical to SEQ ID NO: 4482

SEQ ID NO: 4660 - DNA, 50 bp, Homo sapiens
gccaacagaacagaagaaaatgtttcagacggttccccaaatgccggttc

SEQ ID NO: 4661 - DNA, 50 bp, Homo sapiens
ctctagaaaggcccaagtccatgagcacagagggtctgatgaagtttgtg

SEQ ID NO: 4662 - DNA, 50 bp, Homo sapiens
agaccaagaggatattcctcaaagcagaaagtgaagaagaaatttttgcg

SEQ ID NO: 4663 - DNA, 50 bp, Homo sapiens
tggagaagttccagtcctgtctgagccctgaagagccagctcccgaatcc

SEQ ID NO: 4664 - DNA, 50 bp, Homo sapiens
gaagtagactttctgtcctcacaccgaagaacccgagtgagcaggaggga

SEQ ID NO: 4665 - DNA, 50 bp, Homo sapiens
gtgggatttctggggaggctggtgaaggagggcagggttcttttctctac

SEQ ID NO: 4666 - DNA, 50 bp, Homo sapiens
ctatagcttcatgaccgtaacatgtgacctgtgtgctggcaggacgactc

SEQ ID NO: 4667 - DNA, 50 bp, Homo sapiens
atgatccccatgttgcaatatggagtctctgccctgagatcttccccatc

SEQ ID NO: 4668 - DNA, 50 bp, Homo sapiens
tggtcagtctttgttctctgagaaattatgttggaagcagcatactttca

SEQ ID NO: 4669 - DNA, 50 bp, Homo sapiens
ccccaagatacacactggaccctctcttgctgaatgtgggcattaatttt

SEQ ID NO: 4670 - DNA, 50 bp, Homo sapiens
ttctaacacgtcgccttcaactgtaatcacaacatcctgactccgtcatt

SEQ ID NO: 4671 - DNA, 50 bp, Homo sapiens
tttttcattttggagctagttactgggagtaagggagggtggggtggggg

SEQ ID NO: 4672 - DNA, 50 bp, Homo sapiens
gggactgtcttttctgtattcgctgttcaataaacattgagtgagcacct

SEQ ID NO: 4673 - DNA, 50 bp, Homo sapiens; identical to SEQ ID NO: 4672

SEQ ID NO: 4674 - DNA, 50 bp, Homo sapiens
agagaagactcatcttcactatcggcacgtccaacaccacgggcgagtcg

SEQ ID NO: 4675 - DNA, 50 bp, Homo sapiens
aaaccgaaatattgaaatggtgtaatgttgtaccatttgcactgtgagca

SEQ ID NO: 4676 - DNA, 50 bp, Homo sapiens
aggtgggggaaaatgaattttgtatgctgaatttctaagcgcctattgtt

SEQ ID NO: 4677 - DNA, 50 bp, Homo sapiens
gtggatgtggagcaggagagctggatcgtggcatttgtttctgggttctg

SEQ ID NO: 4678 - DNA, 50 bp, Homo sapiens; identical to SEQ ID NO: 1767

SEQ ID NO: 4679 - DNA, 50 bp, Homo sapiens
tgtggttgcctctatgtgctgtttttcctcatacaagtaaacacagaaag

SEQ ID NO: 4680 - DNA, 50 bp, Homo sapiens
cccaactgaggaccactgtctacagagtcaggaaatattgtagggagaaa

SEQ ID NO: 4681 - DNA, 50 bp, Homo sapiens
tgtttgtttctttgtgttgactttgtccctggcaaaattttccactctga

SEQ ID NO: 4682 - DNA, 50 bp, Homo sapiens
aggtgacctggttacttagctaggattggtgatttgtactgctttatggt

SEQ ID NO: 4683 - DNA, 50 bp, Homo sapiens
ccctacccttgccctttaacttattgggactgaataaagaatggagaggc

SEQ ID NO: 4684 - DNA, 50 bp, Homo sapiens
gggcttttgctctggtgtattttattgtcagaaagtccagactcaagagt

SEQ ID NO: 4685 - DNA, 50 bp, Homo sapiens
tggtctgactgtgctatggcctcatcatcaagactttcaatcctatccca

SEQ ID NO: 4686 - DNA, 50 bp, Homo sapiens
gggcgaggcaggccgactgtactaaagtaacgcaataaacgcattatcag

SEQ ID NO: 4687 - DNA, 50 bp, Homo sapiens
gtacgccgctacctggacagcgcgatgcaggagaaagagttcaaatacac

SEQ ID NO: 4688 - DNA, 50 bp, Homo sapiens; identical to SEQ ID NO: 2679

SEQ ID NO: 4689 - DNA, 50 bp, Homo sapiens; identical to SEQ ID NO: 844

SEQ ID NO: 4690 - DNA, 50 bp, Homo sapiens
tgagcttgctcttacgttttaagaggtgccaggggtacatttttgcactg

SEQ ID NO: 4691 - DNA, 50 bp, Homo sapiens
actggacaactttgagtactgacatcattgataaataaactggcttgtgg

SEQ ID NO: 4692 - DNA, 50 bp, Homo sapiens
cgcagggtctacgaagaatagggtgaaaaacctcagaagggaaaactcca

SEQ ID NO: 4693 - DNA, 50 bp, Homo sapiens
aggttttgtctggttgcatataatctttgctctttttaagctctgtgagc

SEQ ID NO: 4694 - DNA, 50 bp, Homo sapiens
ccttgcagaccccaccccctgcctgctctctttccctacaactaggtcag

SEQ ID NO: 4695 - DNA, 50 bp, Homo sapiens; identical to SEQ ID NO: 2719

SEQ ID NO: 4696 - DNA, 50 bp, Homo sapiens
ggagttgcactctgggtgggaagcactcaaataaagatgcgtggtgttaa

SEQ ID NO: 4697 - DNA, 50 bp, Homo sapiens
agcttttgaaaagtggaaaggtcattttgttgcatttccccatttcttgt

SEQ ID NO: 4698 - DNA, 50 bp, Homo sapiens
acctccttattgaagggaagagggaccagcacatgaggctgaggctgagg

SEQ ID NO: 4699 - DNA, 50 bp, Homo sapiens
ggtatctcccacacagcctggcactccaaccgtaccctttatgagacctg

SEQ ID NO: 4700 - DNA, 50 bp, Homo sapiens
aaggatggtcacacaccagcactttatacacttctggctcacaggaaagt

SEQ ID NO: 4701 - DNA, 50 bp, Homo sapiens
atcatcctgccagcagcactcctcccgttcctccagcgtagactacattt

SEQ ID NO: 4702 - DNA, 50 bp, Homo sapiens
agtgctacactcgtctccactgtttgttttacttccccaaaatggacctt

SEQ ID NO: 4703 - DNA, 50 bp, Homo sapiens
acgctactattacgacaaaaacatcatccacaagacagcggggaaacgct

SEQ ID NO: 4704 - DNA, 50 bp, Homo sapiens
tttgagagggtaggagggtgggaaggaaacaaccatgtcatttcagaagt

SEQ ID NO: 4705 - DNA, 50 bp, Homo sapiens
catgctcagtatcattgtggagaaccaagagggcctcttaactgtaacaa

SEQ ID NO: 4706 - DNA, 50 bp, Homo sapiens
gaccggcttcccctgtgagcagcagagcagcacaataaatgaggccactg

SEQ ID NO: 4707 - DNA, 50 bp, Homo sapiens
gaagataccaacctgtgtgccatccacgctaagagagtcaccatcatgcc

SEQ ID NO: 4708 - DNA, 50 bp, Homo sapiens
gttatcactctgcctgtgtatagtcagatagtccatgcgaaggctgtata

SEQ ID NO: 4709 - DNA, 50 bp, Homo sapiens; identical to SEQ ID NO: 2764

SEQ ID NO: 4710 - DNA, 50 bp, Homo sapiens
taagccagcactcacaccactaacatgccctgttcagctactcccactcc

SEQ ID NO: 4711 - DNA, 50 bp, Homo sapiens
ggatgttttctagttgtgcatgaatgctggcaacttagtaagttttgaca

SEQ ID NO: 4712 - DNA, 50 bp, Homo sapiens
cccaaatagtaatgctttagagggaggcagtcatatctctgtgtgcagat

SEQ ID NO: 4713 - DNA, 50 bp, Homo sapiens; identical to SEQ ID NO: 2779

SEQ ID NO: 4714 - DNA, 50 bp, Homo sapiens
ccccttcctcacactgacctgtgttccttccctgttctcttttctattaa

SEQ ID NO: 4715 - DNA, 50 bp, Homo sapiens
aaactctaccaaggaggatgcactgggcctgcctgcggaacagggtatgt

SEQ ID NO: 4716 - DNA, 50 bp, Homo sapiens
cccttggcacgtaaacagactactagacttattgtaggttcgtttgagct

SEQ ID NO: 4717 - DNA, 50 bp, Homo sapiens
caaaggccagccagcttgggagcagcagagaaataaacagcatttctgat

SEQ ID NO: 4718 - DNA, 50 bp, Homo sapiens
gtgagatcggtgcgttctcctgatgttttgccgtggcttggggattgtac

SEQ ID NO: 4719 - DNA, 50 bp, Homo sapiens
gaactttcaggaagaagcatgttttattctggacacaatgaaagaaacca

SEQ ID NO: 4720 - DNA, 50 bp, Homo sapiens
ttgggtgtagatttctgacatcaaaacttggacccttggaaaacaaaagt

SEQ ID NO: 4721 - DNA, 50 bp, Homo sapiens
caacccagcttccctctgctgtgccacggctgttgcttcggttatttaaa

SEQ ID NO: 4722 - DNA, 50 bp, Homo sapiens; identical to SEQ ID NO: 2827

SEQ ID NO: 4723 - DNA, 50 bp, Homo sapiens
acatgagcttctacctccagatgtgccagggtgcatctcaataaacttgg

SEQ ID NO: 4724 - DNA, 50 bp, Homo sapiens
actgaaaagacaactggctacaaagaaggatgtcagaatgtaaggaaact

SEQ ID NO: 4725 - DNA, 50 bp, Homo sapiens
aagttgtggctgttcttgggaaaggggtcaccgtgtctgacaaagtgtaa

SEQ ID NO: 4726 - DNA, 50 bp, Homo sapiens
cccctcgccccgtcacaccgttatgcattactctgtgtctactattatgt

SEQ ID NO: 4727 - DNA, 50 bp, Homo sapiens
gctgtgagagcttgtttctgattgtttcattgttcgcttctgtaattctg

SEQ ID NO: 4728 - DNA, 50 bp, Homo sapiens; identical to SEQ ID NO: 2863

SEQ ID NO: 4729 - DNA, 50 bp, Homo sapiens
tgctcagtttttcagctcctctccactctgctttcccaaatggattctgt

SEQ ID NO: 4730 - DNA, 50 bp, Homo sapiens
atattcactaccaaaagaggcaagaaagtctgtacccatccaaggaaaaa

SEQ ID NO: 4731 - DNA, 50 bp, Homo sapiens
gctgcattacctctagaaacctcaaacaagtagaaacttgcctagacaat

SEQ ID NO: 4732 - DNA, 50 bp, Homo sapiens
tccaagtcgaaatcgctgctgaggctgagatgaagaaagaaaagtccaaa

SEQ ID NO: 4733 - DNA, 50 bp, Homo sapiens
catctcctcccagaacgtcacagtgctcagagacaaactggtcaagtgtg

SEQ ID NO: 4734 - DNA, 50 bp, Homo sapiens
tttgtctgcacttgagttcacttgagtttacatttgaaatgtgcatgttt

SEQ ID NO: 4735 - DNA, 50 bp, Homo sapiens
agttccctttatttcacataagcccaaactgatagacagtaacggtgttt

SEQ ID NO: 4736 - DNA, 50 bp, Homo sapiens
ggagagggtgggacccagttttgcgtggttggtttttattaattatctgg

SEQ ID NO: 4737 - DNA, 50 bp, Homo sapiens
cctctttccctctgtctgtgcttgtgttgttgacctcctgatggcttgtc

SEQ ID NO: 4738 - DNA, 50 bp, Homo sapiens
ctgattcttctgtcctcattgtgaacataaccgtgtagttgaaacagtca

SEQ ID NO: 4739 - DNA, 50 bp, Homo sapiens
tttccaatgtctgccacacaaacgtatgtaaatgtatatacccacacaca

SEQ ID NO: 4740 - DNA, 50 bp, Homo sapiens
tcctgagaaacaacacatttttccccatgaacggtgctgttctgaagtct

SEQ ID NO: 4741 - DNA, 50 bp, Homo sapiens
tattgccaccatccaactcattgagtcttatggttcacatcttgtttcct

SEQ ID NO: 4742 - DNA, 50 bp, Homo sapiens
agtcctatggttcacatcttgtttcctatagaaatgtcctgtattctggg

SEQ ID NO: 4743 - DNA, 50 bp, Homo sapiens
aaaccaggaagaaaaggtatttctttaaatccagaacaatggagccagct

SEQ ID NO: 4744 - DNA, 50 bp, Homo sapiens
aagcagttggactttcacagcagcaaggaattatcttcaagcacagagga

SEQ ID NO: 4745 - DNA, 50 bp, Homo sapiens
cttcagtgtagctctctcctcttcaaataaacatgtctgccctcatggtt

SEQ ID NO: 4746 - DNA, 50 bp, Homo sapiens
ttctctcgtgcaaccagtttgcccattctcttcctattacttgctccagg

SEQ ID NO: 4747 - DNA, 50 bp, Homo sapiens
tgctcttcagaagtttcaccctttttaatctctcagccacaaacctcagt

SEQ ID NO: 4748 - DNA, 50 bp, Homo sapiens
acgtttactggtactgctttctaaatactgttttacccgttttctcttgt

SEQ ID NO: 4749 - DNA, 50 bp, Homo sapiens
gacaaccaattcaaatgattgtgctaacttatttcccctagttgacctgt

SEQ ID NO: 4750 - DNA, 50 bp, Homo sapiens
ggccaagcccagcttaatggctcatgacctggaaataaaatttaggacca

SEQ ID NO: 4751 - DNA, 50 bp, Homo sapiens
ctcaagacagtgtttgacgaagcgatccgagcagtcctctgcccgcctcc

SEQ ID NO: 4752 - DNA, 50 bp, Homo sapiens
ctttttcaccaccgtcttcaatgcccatgagcctttccgccggggtacag

SEQ ID NO: 4753 - DNA, 50 bp, Homo sapiens
acatcgtatttgcggccagcctctacacccagtgaatgccccatgtaaaa

SEQ ID NO: 4754 - DNA, 50 bp, Homo sapiens
tattccttttatatcactgtgtttgaatcgagggggaggggtggtaaccg

SEQ ID NO: 4755 - DNA, 50 bp, Homo sapiens
atgggaatagttgcatatgggaatttaaaccaacatgtggctgagccttt

SEQ ID NO: 4756 - DNA, 50 bp, Homo sapiens
ggcctttgaatgtaaagctgcataagctgttaggttttgttttaaaagga

SEQ ID NO: 4757 - DNA, 50 bp, Homo sapiens
cagtttggccttatgctttatgcagacttgagtgtatgcaggatttcatt

SEQ ID NO: 4758 - DNA, 50 bp, Homo sapiens
cagaccaagagcaccacagactacaactgcccagcttcatctaaatactt

SEQ ID NO: 4759 - DNA, 50 bp, Homo sapiens
gtgggtaaggggctcaagctgtgatgctgctggttttatctctagtgaaa

SEQ ID NO: 4760 - DNA, 50 bp, Homo sapiens
accctcccaggttcctgctgagatatttctcacaatcagacaagagccag

SEQ ID NO: 4761 - DNA, 50 bp, Homo sapiens
gggcagagaaggtggagagtaaagacccaacattactaacaatgatacag

SEQ ID NO: 4762 - DNA, 50 bp, Homo sapiens; identical to SEQ ID NO: 3039

SEQ ID NO: 4763 - DNA, 50 bp, Homo sapiens
aacacatttgaggaataggaggtccgggttttccataatgggtaaaatgg

SEQ ID NO: 4764 - DNA, 50 bp, Homo sapiens
gctgttccacctcccttcagactatctttcagccttctgccagcagtaaa

SEQ ID NO: 4765 - DNA, 50 bp, Homo sapiens
actataagtcattttgagtgttggtgttaagcatgaaacaaacagcagct

SEQ ID NO: 4766 - DNA, 50 bp, Homo sapiens
gctattcacagttctggggaacaaccaaaggaggaggaggacaaagggaa

SEQ ID NO: 4767 - DNA, 50 bp, Homo sapiens; identical to SEQ ID NO: 1116

SEQ ID NO: 4768 - DNA, 50 bp, Homo sapiens
ctatccacagaagctggccttcgccgagtgcctgtgcagaggctgtatcg

SEQ ID NO: 4769 - DNA, 50 bp, Homo sapiens
gtcatatagtccatgtctgtgatgtgagccaagtgatatcctgtagtaca

SEQ ID NO: 4770 - DNA, 50 bp, Homo sapiens
tccactgggtgaatcctccctctcagaaccaataaaatagaattgacctt

SEQ ID NO: 4771 - DNA, 50 bp, Homo sapiens
gagtttctctatcgcattggtcaaccaaaagagacgcattccattgggcg

SEQ ID NO: 4772 - DNA, 50 bp, Homo sapiens; identical to SEQ ID NO: 183

SEQ ID NO: 4773 - DNA, 50 bp, Homo sapiens
tgcgaaattgtggactgttggactgtgattctaagtgggggaaataggct

SEQ ID NO: 4774 - DNA, 50 bp, Homo sapiens
gaacctttctgaaaccagtggcagcccaagttagagcccagcattaagtc

SEQ ID NO: 4775 - DNA, 50 bp, Homo sapiens
ccagaatcttctattcccacttcccatttctcaaatcatttgacctgtcg

SEQ ID NO: 4776 - DNA, 50 bp, Homo sapiens
cctcctggctgtggtggtctttattcacggctactatgcctgaactctat

SEQ ID NO: 4777 - DNA, 50 bp, Homo sapiens
gaaattaagcgatacgaatcccagcttcgggatcttgagcggcagtcaga

SEQ ID NO: 4778 - DNA, 50 bp, Homo sapiens
tcacagtgaccactacagagtactaagaagagaagatcaagggcatgaaa

SEQ ID NO: 4779 - DNA, 50 bp, Homo sapiens
tcttaaagccagaaataatggaggagattgtgatggaaacacgccagagg

SEQ ID NO: 4780 - DNA, 50 bp, Homo sapiens
cttttctttgtgcagcggtctggttatcgtctatccccaggggaatccac

SEQ ID NO: 4781 - DNA, 50 bp, Homo sapiens
ccacgttggggtcactactggagtggatggaggcccttcacatttctggg

SEQ ID NO: 4782 - DNA, 50 bp, Homo sapiens
tgacctttcgtgattatccgcaaatgcaaacagtttcagatctaatggtt

SEQ ID NO: 4783 - DNA, 50 bp, Homo sapiens
cagtcatggagaccatcgctgtgggctgcacctgcatcttctgaatcacc

SEQ ID NO: 4784 - DNA, 50 bp, Homo sapiens
aggtttcttcatgagtcattccaagttttctagtccataccacagtgcct

SEQ ID NO: 4785 - DNA, 50 bp, Homo sapiens
gaggtcgtcttaaaccagagagctactgaatataagaactcttgcagtct

SEQ ID NO: 4786 - DNA, 50 bp, Homo sapiens
gcagtctcccaaggacccaccatgcagaagtgtcaataaaccacaagttc

SEQ ID NO: 4787 - DNA, 50 bp, Homo sapiens
ggagggagcctctgtgcagatgtgctttctttacagtggctgtaaaaagt

SEQ ID NO: 4788 - DNA, 50 bp, Homo sapiens
gatgcttttaaagttgtagcttcgtgctttgtacagttttctttctggtt

SEQ ID NO: 4789 - DNA, 50 bp, Homo sapiens
aatatatgcaattctccctcccccagcccttccctgacccctaagttatt

SEQ ID NO: 4790 - DNA, 50 bp, Homo sapiens
aatctgccaggctatgtgacagtaggaaggaatggtttcccctaacaagc

SEQ ID NO: 4791 - DNA, 50 bp, Homo sapiens
agcacatacattgatagatggggtgtgggaccaacaaaccaaattaaaag

SEQ ID NO: 4792 - DNA, 50 bp, Homo sapiens; identical to SEQ ID NO: 3240

SEQ ID NO: 4793 - DNA, 50 bp, Homo sapiens
ttgtggaaactgtttcagcaaaggttcttgtatagagggaatagggaatt

SEQ ID NO: 4794 - DNA, 50 bp, Homo sapiens
gggggaaggaaggcttcagacttgggggaaggggagattattgcaaattg

SEQ ID NO: 4795 - DNA, 50 bp, Homo sapiens
ctatggaggaattgagggcaagcacccaggactgatgaggtcttaacaaa

SEQ ID NO: 4796 - DNA, 50 bp, Homo sapiens
acaccaaacagttaagtccattctctggtactagctacaaattcggtttc

SEQ ID NO: 4797 - DNA, 50 bp, Homo sapiens
tgcacacagggagagaacatgagtctctcttaatttttatctggttgcta

SEQ ID NO: 4798 - DNA, 50 bp, Homo sapiens
ttcaatggaaaatgaggggtttctccccactgatattttacatagagtca

SEQ ID NO: 4799 - DNA, 50 bp, Homo sapiens
gaccacattgccaataaaaggtccctgaattccaaattctggaagcacgt

SEQ ID NO: 4800 - DNA, 50 bp, Homo sapiens
aggcccaaatcacagaataaaggactaagagtggatttgctgacattcca

SEQ ID NO: 4801 - DNA, 50 bp, Homo sapiens
gctgtcctcaaagtatataatgtttcatgtaccaagacccttttcacagt

SEQ ID NO: 4802 - DNA, 50 bp, Homo sapiens
aagggtatttggtctggttcatatggtcaaatattactgccttggtagca

SEQ ID NO: 4803 - DNA, 50 bp, Homo sapiens
ggggtgccaggaaatgctctctgacctatcaataaaggaaaagcagtgat

SEQ ID NO: 4804 - DNA, 50 bp, Homo sapiens
tgggaagggaaatttggggattatttatcctcctggggacagtttgggga

SEQ ID NO: 4805 - DNA, 50 bp, Homo sapiens
gccacaaaagttccctctcactttcagtaaaaataaataaaacagcagca

SEQ ID NO: 4806 - DNA, 50 bp, Homo sapiens; identical to SEQ ID NO: 923

SEQ ID NO: 4807 - DNA, 50 bp, Homo sapiens
gatacccaggaatttcacaggaacagttctttgctgcctttatcctccaa

SEQ ID NO: 4808 - DNA, 50 bp, Homo sapiens
cccaccctgccgcccgcattataaacacaggagaataatcaatagaataa

SEQ ID NO: 4809 - DNA, 50 bp, Homo sapiens
aaaccaggcccttaaacttcagctagacaaccaatatgctgtgcttgaaa

SEQ ID NO: 4810 - DNA, 50 bp, Homo sapiens
ccagatccacagcaggcacatatctctccaagggatgaccagttttatgc

SEQ ID NO: 4811 - DNA, 50 bp, Homo sapiens
ggacttgaagaccaaagactttgaaatttgcgagctgctcatgtgtgagt

SEQ ID NO: 4812 - DNA, 50 bp, Homo sapiens
gaaacggcataaagatgagaaatgagcctatttgttagtgttcgtgctta

SEQ ID NO: 4813 - DNA, 50 bp, Homo sapiens
cctgccctcgcctggaatcagtgttactgcatctgattaaatgtctccag

SEQ ID NO: 4814 - DNA, 50 bp, Homo sapiens; identical to SEQ ID NO: 606

SEQ ID NO: 4815 - DNA, 50 bp, Homo sapiens
cagagttgacggacactgctcccaaaaggtcattactcagaataaatgta

SEQ ID NO: 4816 - DNA, 50 bp, Homo sapiens
gaacctcaggcagcagttgtgaaggctttgggggaactagacattcttct

SEQ ID NO: 4817 - DNA, 50 bp, Homo sapiens
ggactgagaagcaagatatcaatgtagcagaattgcacttgtgcctcacg

SEQ ID NO: 4818 - DNA, 50 bp, Homo sapiens
caatggttgcaccttatgaccttgagggaaagccagttcatttaagagga

SEQ ID NO: 4819 - DNA, 50 bp, Homo sapiens
gggggaggggaggggttcgtacaggagcaataaaggagaaactgaggtac

SEQ ID NO: 4820 - DNA, 50 bp, Homo sapiens; identical to SEQ ID NO: 4819

SEQ ID NO: 4821 - DNA, 50 bp, Homo sapiens
acttcttggaactttaactcctgccagcccttctaagacccacgagcggg

SEQ ID NO: 4822 - DNA, 50 bp, Homo sapiens
tgttccatcagcatcccctttttgggcgaggagaaaatcgcaactttttc

SEQ ID NO: 4823 - DNA, 50 bp, Homo sapiens
cagactattccccacctgcttcccagcttcacaataaacggctgcgtctc

SEQ ID NO: 4824 - DNA, 50 bp, Homo sapiens; identical to SEQ ID NO: 4823

SEQ ID NO: 4825 - DNA, 50 bp, Homo sapiens
gtctgtgggcctcatgggcattgtggtgggcactgtcttcatcatccaag

SEQ ID NO: 4826 - DNA, 50 bp, Homo sapiens
ctccaaacagagcaacaacaagtacgcggccagcagctacctgagcctga

SEQ ID NO: 4827 - DNA, 50 bp, Homo sapiens
ccaaagtcctcactcagaccagtgcccctccagttcagttgtctatgtat

SEQ ID NO: 4828 - DNA, 50 bp, Homo sapiens
tgtcttccaccctcaagaaactcttgaacaagaccaacaagaaggcagcg

SEQ ID NO: 4829 - DNA, 50 bp, Homo sapiens
gcaggaccagaccctccaggaaaggcaagagactcatgaccaggggacag

SEQ ID NO: 4830 - DNA, 50 bp, Homo sapiens; identical to SEQ ID NO: 3444

SEQ ID NO: 4831 - DNA, 50 bp, Homo sapiens
agcttggtgtataccttgcaggcactagtcctttacagatgacaatgctg

SEQ ID NO: 4832 - DNA, 50 bp, Homo sapiens
aggaagagccacctgcaagatggacacgagccacaagctgcactgtgaac

SEQ ID NO: 4833 - DNA, 50 bp, Homo sapiens
gggtgcagcatggctctaacaagagaagagatcacagaaacgtgaggatc

SEQ ID NO: 4834 - DNA, 50 bp, Homo sapiens
tacattctccctttagcaacctgagtaagagactctctgccactgggctg

SEQ ID NO: 4835 - DNA, 50 bp, Homo sapiens
aactcttggcctcagaggaaggaaaagcaactcaacactcatggtcaagt

SEQ ID NO: 4836 - DNA, 50 bp, Homo sapiens
agggaacaagggagcaagggaacaagggacatctgaacatctaatgtgag

SEQ ID NO: 4837 - DNA, 50 bp, Homo sapiens
gtggcccctggacgggtacaataacacactgtactgatgtcacaactttg

SEQ ID NO: 4838 - DNA, 50 bp, Homo sapiens
cccctaccctgccccaattcaatcctgccaataaatcctgtcttatttgt

SEQ ID NO: 4839 - DNA, 50 bp, Homo sapiens
acacggaagtgaagattcctgaggatctaacttgcagttggacactatgt

SEQ ID NO: 4840 - DNA, 50 bp, Homo sapiens
cggtccttttgccatacacagttacagagatcagtcaaatccataccacc

SEQ ID NO: 4841 - DNA, 50 bp, Homo sapiens
atacctgtgaggactggttgtctctcttcggtgcccttgagtctctgaat

SEQ ID NO: 4842 - DNA, 50 bp, Homo sapiens
tcatctacttcaggaatcagaaaggacactctggacttcagccaacaggt

SEQ ID NO: 4843 - DNA, 50 bp, Homo sapiens
tgcttcttgaaatggatttaacaacagccaggagcttcctgtcagtaacc

SEQ ID NO: 4844 - DNA, 50 bp, Homo sapiens
ccctccccactgctgctgagtctgtctgatgttttggttgtgtgaataaa

SEQ ID NO: 4845 - DNA, 50 bp, Homo sapiens
aggaggaactggggaaggtggtcattcaggggaagaaccaggatgcaggg

SEQ ID NO: 4846 - DNA, 50 bp, Homo sapiens
tgggaaagtgtgagttaatattggacacattttatcctgatccacagtgg

SEQ ID NO: 4847 - DNA, 50 bp, Homo sapiens
ttaaaaggagcacattaaaattctcagaggacttggcaagggccgcacag

SEQ ID NO: 4848 - DNA, 50 bp, Homo sapiens
gcacacgccatctgtgtaacttcaggatctgttctgtttcaccatgtaac

SEQ ID NO: 4849 - DNA, 50 bp, Homo sapiens; identical to SEQ ID NO: 3493

SEQ ID NO: 4850 - DNA, 50 bp, Homo sapiens
aagagaaatatatgccctagagctgctccagcacccttggtttctgattt

SEQ ID NO: 4851 - DNA, 50 bp, Homo sapiens
acagacagactcgatgcccacacagcttcactctttgagcaacatggaat

SEQ ID NO: 4852 - DNA, 50 bp, Homo sapiens
gcacggtgtgttgccacgatttgaccctcaacttctagcagtatatcagt

SEQ ID NO: 4853 - DNA, 50 bp, Homo sapiens
agtgtagttactagtcttttgacatggatgattctgaggaggaagctgtt

SEQ ID NO: 4854 - DNA, 50 bp, Homo sapiens
tcactgccatacaggttttccaatacacaagtgctagaaaatacacacaa

SEQ ID NO: 4855 - DNA, 50 bp, Homo sapiens
ttgcttgccctccatgtcttcctaaagagcagaacttggagtttctcctt

SEQ ID NO: 4856 - DNA, 50 bp, Homo sapiens
agaatgagcctgaatgttggtggtttttgaaatcctgacttggaggtaaa

SEQ ID NO: 4857 - DNA, 50 bp, Homo sapiens
cctcggccctgacaaacggggatcttttacctcactttgcactgattaat

SEQ ID NO: 4858 - DNA, 50 bp, Homo sapiens
tggcttggccttctctttggtgatcccacccccagccatttgcattgctg

SEQ ID NO: 4859 - DNA, 50 bp, Homo sapiens
aatgtttctcttcctgtgagacttactaaagcaacttagtggcaaaaagt

SEQ ID NO: 4860 - DNA, 50 bp, Homo sapiens
agtacttgagtagtctcaataggagtgtatttgtagacagcagtttccct

SEQ ID NO: 4861 - DNA, 50 bp, Homo sapiens
accctagatgagctgtcctgctccagtaacattctttttctaaaatcatt

SEQ ID NO: 4862 - DNA, 50 bp, Homo sapiens; identical to SEQ ID NO: 971

SEQ ID NO: 4863 - DNA, 50 bp, Homo sapiens
atttgagttcctgtgtgtccaaaactgaggcaccatgttctttgaaaaca

SEQ ID NO: 4864 - DNA, 50 bp, Homo sapiens; identical to SEQ ID NO: 4863

SEQ ID NO: 4865 - DNA, 50 bp, Homo sapiens; identical to SEQ ID NO: 4863

SEQ ID NO: 4866 - DNA, 50 bp, Homo sapiens
gtccacagcggaccctgctgatgcctccaccatctatgcagttgtagttt

SEQ ID NO: 4867 - DNA, 50 bp, Homo sapiens
caggctcccatatgtaccccatcccccatactcacctctttccattttga

SEQ ID NO: 4868 - DNA, 50 bp, Homo sapiens
gttgtattggcaagagggaggggtgagagctgttggagaactgagaatga

SEQ ID NO: 4869 - DNA, 50 bp, Homo sapiens
gtaccatcctcaccgtagtcatcatcatcgccgcgcagcaccacgagaac

SEQ ID NO: 4870 - DNA, 50 bp, Homo sapiens; identical to SEQ ID NO: 817

SEQ ID NO: 4871 - DNA, 50 bp, Homo sapiens
atcgctgaatatgttgatcagtgatgagttgggcttaatgcaaagatcct

SEQ ID NO: 4872 - DNA, 50 bp, Homo sapiens
aggctatttacttccatgcttctccttttcttactctatagtggcaacat

SEQ ID NO: 4873 - DNA, 50 bp, Homo sapiens
gggacccccacccagtgagtcaacataggctcatgtcaagtttgaaaata

SEQ ID NO: 4874 - DNA, 50 bp, Homo sapiens
tggtgtgatatgaaccagtccattcacattggaaaaactgatggttttaa

SEQ ID NO: 4875 - DNA, 50 bp, Homo sapiens
tttttatcagcgcctcaatctctactcgaagaagaaagagaagaaacgtt

SEQ ID NO: 4876 - DNA, 50 bp, Homo sapiens
cgctgtcgccttaatccaagcctacgttttcacacttctagtaagcctct

SEQ ID NO: 4877 - DNA, 50 bp, Homo sapiens
ctgtcgggctctgaagcgagctggtttagttgtagaagatgctctgtttg

SEQ ID NO: 4878 - DNA, 50 bp, Homo sapiens
agaagcagaatgcagaaggagaatgaatcctttggatactttcaaggaca

SEQ ID NO: 4879 - DNA, 50 bp, Homo sapiens
tctggcacagtccagctcacaacaacatcaagagcagaatttggagactt

SEQ ID NO: 4880 - DNA, 50 bp, Homo sapiens
gggacttgactttctttctggactgtttgtattgaaacaaagtggtgtca

SEQ ID NO: 4881 - DNA, 50 bp, Homo sapiens; identical to SEQ ID NO: 607

SEQ ID NO: 4882 - DNA, 50 bp, Homo sapiens
agactggtgatttggagtagtttacaagattcctcattcagagtgccctc

SEQ ID NO: 4883 - DNA, 50 bp, Homo sapiens
ttgcctcctccaatctgtgttctcaactgtggttgccacctcattaactt

SEQ ID NO: 4884 - DNA, 50 bp, Homo sapiens
tggaacataccacatgtagaaaggttgaactggtttttcagctataatgc

SEQ ID NO: 4885 - DNA, 50 bp, Homo sapiens
tcacttagcctttctggtttcccttcctgtgcattgcccattttctcatg

SEQ ID NO: 4886 - DNA, 50 bp, Homo sapiens
agccaagaggtatatcgatgatggaaattagccacatgtacactacattt

SEQ ID NO: 4887 - DNA, 50 bp, Homo sapiens
cttcaccgccctacttccacctccgcccagcctgtaatgtttatataagc

SEQ ID NO: 4888 - DNA, 50 bp, Homo sapiens
ctttcagagccagtttgtccaaggccagcatcccgtctgggagatgcacc

SEQ ID NO: 4889 - DNA, 50 bp, Homo sapiens
gccgtatattactgtgcgagagggccggagtggttactcggtatggacgt

SEQ ID NO: 4890 - DNA, 50 bp, Homo sapiens
aggcaaaagcgcctcacgcattcttgttccttgtttgcttcttcggtttt

SEQ ID NO: 4891 - DNA, 50 bp, Homo sapiens
ttagaaagaaaagtcttttattagtactgtgtagggaaggctaaagaaat

SEQ ID NO: 4892 - DNA, 50 bp, Homo sapiens
actgtgcgaaacgtactgtattacgatttttggagtggccgaagtagtcc

SEQ ID NO: 4893 - DNA, 50 bp, Homo sapiens
cagaccctggtgatgctggaaacagttcctcggagtggagaggtttacac

SEQ ID NO: 4894 - DNA, 50 bp, Homo sapiens
gtccagcaacagtgcccagggctctgatgagtctctcatcgcttgtaaag

SEQ ID NO: 4895 - DNA, 50 bp, Homo sapiens
gtgtattactgtgcgagagccttccgccatcccggagtacgtccaatatg

SEQ ID NO: 4896 - DNA, 50 bp, Homo sapiens
cccgtccctcaagagtcgagtcaccatatcagtagacaagtccaagaacc

SEQ ID NO: 4897 - DNA, 50 bp, Homo sapiens
ggctccaggctcaggatgaggctgattattactgctgctcatatacaagc

SEQ ID NO: 4898 - DNA, 50 bp, Homo sapiens
ccctcactgtcaccttcccgagaataccctaagaccaataaatacttcag

SEQ ID NO: 4899 - DNA, 50 bp, Homo sapiens
tgaatgacttctatctgggaatcttgacggtgacctggaaggcagatggt

SEQ ID NO: 4900 - DNA, 50 bp, Homo sapiens; identical to SEQ ID NO: 2269

SEQ ID NO: 4901 - DNA, 50 bp, Homo sapiens
agaacagagatgattacacctacgaagtctgagttatggtgtgagttgga

SEQ ID NO: 4902 - DNA, 50 bp, Homo sapiens
ttcatcattgcttgcttgccttcctccctcctgtccgctctcactcactc

SEQ ID NO: 4903 - DNA, 50 bp, Homo sapiens; identical to SEQ ID NO: 2215

SEQ ID NO: 4904 - DNA, 50 bp, Homo sapiens
tgaagaacgaccaaaattatttgaagaactagggaaacagatccaacagt

SEQ ID NO: 4905 - DNA, 50 bp, Homo sapiens
gtctacatacttcccaggcacccagcatggaaataaagcacccaccactg

SEQ ID NO: 4906 - DNA, 50 bp, Homo sapiens
atacttcccaggcacccagcatggaaataaagcacccaccactgccctgg

SEQ ID NO: 4907 - DNA, 50 bp, Homo sapiens
cccaaggcatcaagcccttctccctgcactcaataaaccctcaataaata

SEQ ID NO: 4908 - DNA, 50 bp, Homo sapiens
aaggcagagatcttgacacctaaggagtctagtttagggctttggttgga

SEQ ID NO: 4909 - DNA, 50 bp, Homo sapiens
gttgacattagaagcaggattctctggtactccctcagaaaatagaatgc

SEQ ID NO: 4910 - DNA, 50 bp, Homo sapiens
ttggagcgtttttgtgtttgagatattagctcaggtcaattccaaagagt

SEQ ID NO: 4911 - DNA, 50 bp, Homo sapiens; identical to SEQ ID NO: 389

SEQ ID NO: 4912 - DNA, 50 bp, Homo sapiens; identical to SEQ ID NO: 392

SEQ ID NO: 4913 - DNA, 50 bp, Homo sapiens; identical to SEQ ID NO: 394

SEQ ID NO: 4914 - DNA, 50 bp, Homo sapiens
tctgttaccacctctaaaatattggggtggaataaagctgggttcttgca

SEQ ID NO: 4915 - DNA, 50 bp, Homo sapiens; identical to SEQ ID NO: 402

SEQ ID NO: 4916 - DNA, 50 bp, Homo sapiens; identical to SEQ ID NO: 403

SEQ ID NO: 4917 - DNA, 50 bp, Homo sapiens; identical to SEQ ID NO: 404

SEQ ID NO: 4918 - DNA, 50 bp, Homo sapiens
gggtaggcagcttgcacccagttctcctttatctcaacttattgtcctgg

SEQ ID NO: 4919 - DNA, 50 bp, Homo sapiens
acttggaacagaagaacttcggcaacgagaacactatctcaagcagaaga

SEQ ID NO: 4920 - DNA, 50 bp, Homo sapiens
gcggtgtccctgagtgagggcaaagttgtaataacacttgttctctcctt

SEQ ID NO: 4921 - DNA, 50 bp, Homo sapiens; identical to SEQ ID NO: 407

SEQ ID NO: 4922 - DNA, 50 bp, Homo sapiens; identical to SEQ ID NO: 408

SEQ ID NO: 4923 - DNA, 50 bp, Homo sapiens
ggctagtggtgttcagagaaataccaaaacgtgtttttatcattgctggt

SEQ ID NO: 4924 - DNA, 50 bp, Homo sapiens
agctgcctcaggaggttcttaacatataggaatgtaattatcagattcaa

SEQ ID NO: 4925 - DNA, 50 bp, Homo sapiens
aggaaaccaagccctcacaggaaagaaagcctgattcaagaaaacaaagt

SEQ ID NO: 4926 - DNA, 50 bp, Homo sapiens; identical to SEQ ID NO: 418

SEQ ID NO: 4927 - DNA, 50 bp, Homo sapiens; identical to SEQ ID NO: 419

SEQ ID NO: 4928 - DNA, 50 bp, Homo sapiens
gccattttccctccagaaacaaaaccaagataatttatcctgaacacggt

SEQ ID NO: 4929 - DNA, 50 bp, Homo sapiens; identical to SEQ ID NO: 421

SEQ ID NO: 4930 - DNA, 50 bp, Homo sapiens
aggaccatagggaagagccagccttgccttttcttatatgattttgttta

SEQ ID NO: 4931 - DNA, 50 bp, Homo sapiens; identical to SEQ ID NO: 424

SEQ ID NO: 4932 - DNA, 50 bp, Homo sapiens; identical to SEQ ID NO: 429

SEQ ID NO: 4933 - DNA, 50 bp, Homo sapiens
tcgttctacgttatctcatctccttgttttcagtgtgcttcaataatgca

SEQ ID NO: 4934 - DNA, 50 bp, Homo sapiens; identical to SEQ ID NO: 432

SEQ ID NO: 4935 - DNA, 50 bp, Homo sapiens
tgcacttactcattagtttttagtttgaactctcctgcgaggtctaatgt

SEQ ID NO: 4936 - DNA, 50 bp, Homo sapiens
tggttcttctgatgagcaagggaacaacactgagaatgaggaggaggagt

SEQ ID NO: 4937 - DNA, 50 bp, Homo sapiens
aagcaagagattgtaaaccgggtacagatccaagagatgagagaggaccc

SEQ ID NO: 4938 - DNA, 50 bp, Homo sapiens
cgtctactgcggaaaagtcaggggaaactgccaaacaaaggaaaatgccc

SEQ ID NO: 4939 - DNA, 50 bp, Homo sapiens
gtgtttgacttcactgctgcgaaatgactgtctcctggctagtaggatct

SEQ ID NO: 4940 - DNA, 50 bp, Homo sapiens; identical to SEQ ID NO: 1311

SEQ ID NO: 4941 - DNA, 50 bp, Homo sapiens; identical to SEQ ID NO: 1315

SEQ ID NO: 4942 - DNA, 50 bp, Homo sapiens; identical to SEQ ID NO: 1320

SEQ ID NO: 4943 - DNA, 50 bp, Homo sapiens; identical to SEQ ID NO: 1321

SEQ ID NO: 4944 - DNA, 50 bp, Homo sapiens
atgtctataaatggtgtcataactagagcacgggcgttatgtaagtttct

SEQ ID NO: 4945 - DNA, 50 bp, Homo sapiens; identical to SEQ ID NO: 1340

SEQ ID NO: 4946 - DNA, 50 bp, Homo sapiens
acataggcgaagaaaacatggcattgagtgtgctgagtccagacaaatgt

SEQ ID NO: 4947 - DNA, 50 bp, Homo sapiens; identical to SEQ ID NO: 1350

SEQ ID NO: 4948 - DNA, 50 bp, Homo sapiens; identical to SEQ ID NO: 1352

SEQ ID NO: 4949 - DNA, 50 bp, Homo sapiens; identical to SEQ ID NO: 1353

SEQ ID NO: 4950 - DNA, 50 bp, Homo sapiens; identical to SEQ ID NO: 1355

SEQ ID NO: 4951 - DNA, 50 bp, Homo sapiens; identical to SEQ ID NO: 1358

SEQ ID NO: 4952 - DNA, 50 bp, Homo sapiens; identical to SEQ ID NO: 4468

SEQ ID NO: 4953 - DNA, 50 bp, Homo sapiens
aatcacagcagtaactcccagtaggaaagattctcaaaggaatagttctt

SEQ ID NO: 4954 - DNA, 50 bp, Homo sapiens
cctggccttcaagaagtcgtagtggctattttctttggacaaaagtaaga

SEQ ID NO: 4955 - DNA, 50 bp, Homo sapiens
atagacagacggaggtcctgatatccatgggccaacggcttggattattc

SEQ ID NO: 4956 - DNA, 50 bp, Homo sapiens; identical to SEQ ID NO: 1510

SEQ ID NO: 4957 - DNA, 50 bp, Homo sapiens; identical to SEQ ID NO: 1517

SEQ ID NO: 4958 - DNA, 50 bp, Homo sapiens
gatatcagacagcatcgtctctgcgagcacaaagatctgtttgctgagca

SEQ ID NO: 4959 - DNA, 50 bp, Homo sapiens; identical to SEQ ID NO: 1537

SEQ ID NO: 4960 - DNA, 50 bp, Homo sapiens; identical to SEQ ID NO: 1548

SEQ ID NO: 4961 - DNA, 50 bp, Homo sapiens
aattaacggccatcacacccacgactgacggtgatcaaacaaattcacag

SEQ ID NO: 4962 - DNA, 50 bp, Homo sapiens; identical to SEQ ID NO: 1559

SEQ ID NO: 4963 - DNA, 50 bp, Homo sapiens; identical to SEQ ID NO: 3876

SEQ ID NO: 4964 - DNA, 50 bp, Homo sapiens
ctcatagcatagccagcattcagcacacacaaacctactgcccacatttg

SEQ ID NO: 4965 - DNA, 50 bp, Homo sapiens
cacatttgaaggccaaagggaaaacgggggaagcggaagggttggattgg

SEQ ID NO: 4966 - DNA, 50 bp, Homo sapiens
tacgaccactgagaaacgggccacccggcacacggatcttggaacacaaa

SEQ ID NO: 4967 - DNA, 50 bp, Homo sapiens; identical to SEQ ID NO: 3927

SEQ ID NO: 4968 - DNA, 50 bp, Homo sapiens; identical to SEQ ID NO: 3930

SEQ ID NO: 4969 - DNA, 50 bp, Homo sapiens; identical to SEQ ID NO: 3935

SEQ ID NO: 4970 - DNA, 50 bp, Homo sapiens; identical to SEQ ID NO: 3945

SEQ ID NO: 4971 - DNA, 50 bp, Homo sapiens; identical to SEQ ID NO: 3961

SEQ ID NO: 4972 - DNA, 50 bp, Homo sapiens; identical to SEQ ID NO: 3962

SEQ ID NO: 4973 - DNA, 50 bp, Homo sapiens
gcaggttatcgcaagatgtcttagagtagggttacggttctcagtgacac

SEQ ID NO: 4974 - DNA, 50 bp, Homo sapiens
aaatggctttaccaaacattgtcagtacctttacgtgttagaaggcattt

SEQ ID NO: 4975 - DNA, 50 bp, Homo sapiens; identical to SEQ ID NO: 3966

SEQ ID NO: 4976 - DNA, 50 bp, Homo sapiens
ccctacttgattaaagattgaggtggaattctagatgtggtcattcgtgt

SEQ ID NO: 4977 - DNA, 50 bp, Homo sapiens; identical to SEQ ID NO: 3981

SEQ ID NO: 4978 - DNA, 50 bp, Homo sapiens
agaaatggtacggggaatgtgaataacacgaaatggtatggggaaatgtg

SEQ ID NO: 4979 - DNA, 50 bp, Homo sapiens; identical to SEQ ID NO: 4002

SEQ ID NO: 4980 - DNA, 50 bp, Homo sapiens
tgttcttgtgctgctgttatctatactatttttgttcgtgccttctgact

SEQ ID NO: 4981 - DNA, 50 bp, Homo sapiens
gtctgggtgccaacttgagacaggtggtctaggaaattgcggtaagagcg

SEQ ID NO: 4982 - DNA, 50 bp, Homo sapiens; identical to SEQ ID NO: 4009

SEQ ID NO: 4983 - DNA, 50 bp, Homo sapiens; identical to SEQ ID NO: 4010

SEQ ID NO: 4984 - DNA, 50 bp, Homo sapiens
aggctgattcttggagatttaacaccccacaggcaatgggtttatagaca

SEQ ID NO: 4985 - DNA, 50 bp, Homo sapiens
tctcctttcagttcctttgtaggatttctgggcttgaaggatagtcttca

SEQ ID NO: 4986 - DNA, 50 bp, Homo sapiens; identical to SEQ ID NO: 4031

SEQ ID NO: 4987 - DNA, 50 bp, Homo sapiens
agaatgtcccacttgctgtctcttagaggctgagcttcatttctatgagc

SEQ ID NO: 4988 - DNA, 50 bp, Homo sapiens
caacctctggagagtgcctactgttagaagctgaagggatgtcaaagtca

SEQ ID NO: 4989 - DNA, 50 bp, Homo sapiens; identical to SEQ ID NO: 4041

SEQ ID NO: 4990 - DNA, 50 bp, Homo sapiens
gcctcagtacagagggggctctggaagtgtttgttgactgaataaacgga

SEQ ID NO: 4991 - DNA, 50 bp, Homo sapiens; identical to SEQ ID NO: 4054

SEQ ID NO: 4992 - DNA, 50 bp, Homo sapiens
tgcctaagagcaaagcatcctctgcgacaaaagaaaattactgtagtggc

SEQ ID NO: 4993 - DNA, 50 bp, Homo sapiens; identical to SEQ ID NO: 4057

SEQ ID NO: 4994 - DNA, 50 bp, Homo sapiens
gacatggagcccccggaaaagcgggtctggacaccaagtcgatgtgtgag

SEQ ID NO: 4995 - DNA, 50 bp, Homo sapiens
acagaatcagattttgcaggtgtccaacctatagtggctaagaattatgt

SEQ ID NO: 4996 - DNA, 50 bp, Homo sapiens; identical to SEQ ID NO: 4067

SEQ ID NO: 4997 - DNA, 50 bp, Homo sapiens; identical to SEQ ID NO: 4070

SEQ ID NO: 4998 - DNA, 50 bp, Homo sapiens; identical to SEQ ID NO: 4075

SEQ ID NO: 4999 - DNA, 50 bp, Homo sapiens; identical to SEQ ID NO: 4077

SEQ ID NO: 5000 - DNA, 50 bp, Homo sapiens
tggagatccttctacttggctgctgtattcatgcattatgttggtttgag

SEQ ID NO: 5001 - DNA, 50 bp, Homo sapiens
atttgtaccaaatctttgggattcattggcaaataatttcagtgtggtgt

SEQ ID NO: 5002 - DNA, 50 bp, Homo sapiens
ggttttagcagttctttagcccgtggtatttcagtgttgggtttcatagc

SEQ ID NO: 5003 - DNA, 50 bp, Homo sapiens
gggagccataagaacgactccaaaaagagccccaaaggaggacaaggggg

SEQ ID NO: 5004 - DNA, 50 bp, Homo sapiens
tcagggtcttggatactcaagagaaaggagacttgtggttaatgtttgga

SEQ ID NO: 5005 - DNA, 50 bp, Homo sapiens
tccttagcacacgaaaaagccccttcccctggattcatgtttcttatttc

SEQ ID NO: 5006 - DNA, 50 bp, Homo sapiens
aagcaagtagacaccttcataactatgaatgaagctgctgaagtagtgtt

SEQ ID NO: 5007 - DNA, 50 bp, Homo sapiens
tccattaaagatcgcaaatgttgaggtcctgtagcctgaaaactctctgc

SEQ ID NO: 5008 - DNA, 50 bp, Homo sapiens
ctgattcaaacaggttccaacgtaaaacgttcacacttccaccatttcct

SEQ ID NO: 5009 - DNA, 50 bp, Homo sapiens
tgatgttggtatgcttgccctgttacttatagacagtctttgtcataggc

SEQ ID NO: 5010 - DNA, 50 bp, Homo sapiens
ggtctttgtcccagtagagttcatagtctatttagtgtgcatgtttttcc

SEQ ID NO: 5011 - DNA, 50 bp, Homo sapiens
ttgtgtccaaaagtgttaacgaagactacttaacccaatgattggcgcga

SEQ ID NO: 5012 - DNA, 50 bp, Homo sapiens
atgcgtggatattgagaacttaggtgtctaatggggaggattattgctgt

SEQ ID NO: 5013 - DNA, 50 bp, Homo sapiens
aagcatttccatttcaacgagtttgtcagctttattaatgttgggcaaaa

SEQ ID NO: 5014 - DNA, 50 bp, Homo sapiens
aaacctaccactttaagaagacagcgatgggtaattctttattggcaggt

SEQ ID NO: 5015 - DNA, 50 bp, Homo sapiens
attcagcattagtttctcacatcttcccccaggtatccccaacagaatta

SEQ ID NO: 5016 - DNA, 50 bp, Homo sapiens
acacctctcttagggctccatcaaacagaacttttagactgagtaacgct

SEQ ID NO: 5017 - DNA, 50 bp, Homo sapiens; identical to SEQ ID NO: 4297

SEQ ID NO: 5018 - DNA, 50 bp, Homo sapiens
accatgaacagtgtgttgcttcagactattacaaagagaatggggcaggt

SEQ ID NO: 5019 - DNA, 50 bp, Homo sapiens
tttttgaaaagtatgtttggtagaaattagttgtatgccctcaggacggt

SEQ ID NO: 5020 - DNA, 50 bp, Homo sapiens
gaaattagtgtgaacatgtgggaagcccgatgcatgtgggtcagggatct

SEQ ID NO: 5021 - DNA, 50 bp, Homo sapiens
tccctgggtgataccattcaatgtcttaatgtacttgtggctcagacctg

SEQ ID NO: 5022 - DNA, 50 bp, Homo sapiens
cagacagcacagcctgagggtagcagcagccacccatgttcaggtaagtc

SEQ ID NO: 5023 - DNA, 50 bp, Homo sapiens
gccatgaggtggaggacgtggacctggagctgttcaacatctcggtgcag

SEQ ID NO: 5024 - DNA, 50 bp, Homo sapiens
tctgcacccaaacaaataccttttgagatttcttataggcattcctctcg

SEQ ID NO: 5025 - DNA, 50 bp, Homo sapiens
gaagctctgccgcagcgccaggcacttcctacaccactactacgtccacg

SEQ ID NO: 5026 - DNA, 50 bp, Homo sapiens
cagctcggaccaccgccacctccctttttatttacagatcacccagtaag

SEQ ID NO: 5027 - DNA, 50 bp, Homo sapiens
ggtcccctcctggagactccctcacaaaatctttccccaagctgttcccc

SEQ ID NO: 5028 - DNA, 50 bp, Homo sapiens
tgaatgggcgtttatcttaatgaccagttattgaccaaagtgtactcaga

SEQ ID NO: 5029 - DNA, 50 bp, Homo sapiens
agcctattcctattctctagcctattccttaccacctgtaatcttgacca

SEQ ID NO: 5030 - DNA, 50 bp, Homo sapiens
gcaatgggcggccaactatgaaccctacgtggtggtgccacgagactgtc

SEQ ID NO: 5031 - DNA, 50 bp, Homo sapiens
gcctggagcttggctttgtatccaagtgtatggttgctttgtctaagagg

SEQ ID NO: 5032 - DNA, 50 bp, Homo sapiens; identical to SEQ ID NO: 1495

SEQ ID NO: 5033 - DNA, 50 bp, Homo sapiens
agcctacaagccacctcgccactgtgaacttgtcgtcactcttggatgtc

SEQ ID NO: 5034 - DNA, 50 bp, Homo sapiens
cctgctcacagaccaggaactctacaagctggaccctgaccggcagtacc

SEQ ID NO: 5035 - DNA, 50 bp, Homo sapiens
agcagttccacagtgtttcacactacaggatttaaatattttgctccaga

SEQ ID NO: 5036 - DNA, 50 bp, Homo sapiens
cctttatccacctggattttagggacaaacactgaaaacgaataagtcca

SEQ ID NO: 5037 - DNA, 50 bp, Homo sapiens; identical to SEQ ID NO: 5036

SEQ ID NO: 5038 - DNA, 50 bp, Homo sapiens
cagagaacgaaagtcaagtgcagcgagttgggtggaagctgatagagcaa

SEQ ID NO: 5039 - DNA, 50 bp, Homo sapiens
ccacaaaccattcagatcaggcacttgctgaccctggttcttaaggacac

SEQ ID NO: 5040 - DNA, 50 bp, Homo sapiens
aagaaactatgtagcatagtgtcttaacacctcagtaaagtaagctggcc

SEQ ID NO: 5041 - DNA, 50 bp, Homo sapiens
agcaggagacagcttcctgatctagatgtacaattagagtttaggttgga

SEQ ID NO: 5042 - DNA, 50 bp, Homo sapiens
tggaactagtcacaattgaagttcttcatccagtaggtgttaaacagtgt

SEQ ID NO: 5043 - DNA, 50 bp, Homo sapiens
cccacacaagtgcgccacataaatctgcgagactccacgacaacacaggg

SEQ ID NO: 5044 - DNA, 50 bp, Homo sapiens
gcaaacaagttctaaagttgtggagaaaaagtgatgtggtcaagagttga

SEQ ID NO: 5045 - DNA, 50 bp, Homo sapiens
gcaagaaagagaaacgtaaaaacagatagagattctgcctgtgctttggt

SEQ ID NO: 5046 - DNA, 50 bp, Homo sapiens
gagagttgctggtgtaaaatacgtttgaaatagttgatctacaaaggcca

SEQ ID NO: 5047 - DNA, 50 bp, Homo sapiens
ggttaacgcttctgtgaggaccttctggctcttgagataccctaaatatt

SEQ ID NO: 5048 - DNA, 50 bp, Homo sapiens
actttcattggtaaataagcctgtcttcctatctggatttttggtgtgca

SEQ ID NO: 5049 - DNA, 50 bp, Homo sapiens
cagttatttaaaggctgacaactgccttccagacccgcgctgtattaata

SEQ ID NO: 5050 - DNA, 50 bp, Homo sapiens
tggtgggtacagaaacattgtcacagggatcctggaacagaggaagagtt

SEQ ID NO: 5051 - DNA, 50 bp, Homo sapiens
ttctgacctaataattacgggaaatggaaagtctgggccagcatcaataa

SEQ ID NO: 5052 - DNA, 50 bp, Homo sapiens
tgggtcggcaaagctattataactttgaatgctaacggcatgtttgacct

SEQ ID NO: 5053 - DNA, 50 bp, Homo sapiens
gctgtgtcctttctggcacaatcggggattccattctttagacactggaa

SEQ ID NO: 5054 - DNA, 50 bp, Homo sapiens
ttgacaaagatgacatcgccccaagagccaaaaataaatgggaattgaaa

SEQ ID NO: 5055 - DNA, 50 bp, Homo sapiens
gtaaagatcagaataccaaggccagctaaggcaacgactccctccccaaa

SEQ ID NO: 5056 - DNA, 50 bp, Homo sapiens; identical to SEQ ID NO: 1668

SEQ ID NO: 5057 - DNA, 50 bp, Homo sapiens
atgctggtgtcatgtgacatttgttgagtctcgggcatgttcacggtggg

SEQ ID NO: 5058 - DNA, 50 bp, Homo sapiens
ggaaattgtgccaaaaccatggaaaatattactgtgtgtggggtgtctgt

SEQ ID NO: 5059 - DNA, 50 bp, Homo sapiens
tttgtgtgtgaaatataacattgattgaattgcagttacatttggttagt

SEQ ID NO: 5060 - DNA, 50 bp, Homo sapiens; identical to SEQ ID NO: 1868

SEQ ID NO: 5061 - DNA, 50 bp, Homo sapiens
taaggttaggcaataacttaggggtatattctcttcctgcatcccagtgc

SEQ ID NO: 5062 - DNA, 50 bp, Homo sapiens
taaggtgtttgctgggggatgttgtgtgtattaggggagtgtttcccttg

SEQ ID NO: 5063 - DNA, 50 bp, Homo sapiens; identical to SEQ ID NO: 3550

SEQ ID NO: 5064 - DNA, 50 bp, Homo sapiens; identical to SEQ ID NO: 3567

SEQ ID NO: 5065 - DNA, 50 bp, Homo sapiens
actggtgttggtgcttttgtctgtcataccatagtattttcaaaacttca

SEQ ID NO: 5066 - DNA, 50 bp, Homo sapiens
ccttgagaaacacccatctccacttcctagacaaaccaatgaacattagt

SEQ ID NO: 5067 - DNA, 50 bp, Homo sapiens; identical to SEQ ID NO: 3688

SEQ ID NO: 5068 - DNA, 50 bp, Homo sapiens
ctaagtcattgcaggaacggggctgtgttctctgctgggacaaaacagga

SEQ ID NO: 5069 - DNA, 50 bp, Homo sapiens
gccgttctttatagaacaattcctttctcttctcttgaatgtggcagtca

SEQ ID NO: 5070 - DNA, 50 bp, Homo sapiens
agcctacctccctaccccaagctgtctgttgagagcagtgctgaccccag

SEQ ID NO: 5071 - DNA, 50 bp, Homo sapiens
tttcataaacccactccttcctcttcacccacttgcaatccgcatgcttc

SEQ ID NO: 5072 - DNA, 50 bp, Homo sapiens
caagttggtttagttatgtaacaacctgacatgatggaggaaaacaacct

SEQ ID NO: 5073 - DNA, 50 bp, Homo sapiens
gactcgttacgccgtagtttgtcctatcttgtttatcaaatgaatttcgt

SEQ ID NO: 5074 - DNA, 50 bp, Homo sapiens
agccgcccagctacttaatccctcagtaacatctatctaaatctcccatg

SEQ ID NO: 5075 - DNA, 50 bp, Homo sapiens
tggcctgtgcttttaccacaccgtcaaacccttgatcatttctgtaaaca

SEQ ID NO: 5076 - DNA, 50 bp, Homo sapiens
acattctcatagtccaggggctcaacaactttggccttttccagcaccac

SEQ ID NO: 5077 - DNA, 50 bp, Homo sapiens
tcagcagttgtgccttttctcacagatccagccgtccttctcgctgtcac

SEQ ID NO: 5078 - DNA, 50 bp, Homo sapiens
tgcaagcaataaaatcttgctttaatcagtaaccactgtctgacaggaca

SEQ ID NO: 5079 - DNA, 50 bp, Homo sapiens
ggtcgtagagaagacagcaagggaggggataaaacccaggaaggacttaa

SEQ ID NO: 5080 - DNA, 50 bp, Homo sapiens
ggctcacgatgacaaccgcctacggaaaaactctaattcctaaacatcta

SEQ ID NO: 5081 - DNA, 50 bp, Homo sapiens
gacaagccaggtcagcccagattgccaaagcagcacttgcctacaccagc

SEQ ID NO: 5082 - DNA, 50 bp, Homo sapiens
ggttcccttgaagcagtgccaacctaaatctacctcaggtaagtagttag

SEQ ID NO: 5083 - DNA, 50 bp, Homo sapiens
gctgacagtatggaggctaaaggtgtggaggaaccaggaggagatgagta

SEQ ID NO: 5084 - DNA, 50 bp, Homo sapiens
caagtgtgccgggcaagtttgggaaggtgaagcaatctgtgacttaaata

SEQ ID NO: 5085 - DNA, 51 bp, Homo sapiens
gagctactcaaggggaaaaaagggcatatagtatgctctggtagtaaaagt

SEQ ID NO: 5086 - DNA, 50 bp, Homo sapiens; identical to SEQ ID NO: 4220

SEQ ID NO: 5087 - DNA, 50 bp, Homo sapiens
tggtgataatagagattgtttctgccctgggggtagttcaaggataacac

SEQ ID NO: 5088 - DNA, 50 bp, Homo sapiens
cttcaggtttggcccagcccctccttgaagactccttccatccagtcaag

SEQ ID NO: 5089 - DNA, 50 bp, Homo sapiens
cccaagtgaagtcaaagttactgtgtggttgatagggaacatggctggat

SEQ ID NO: 5090 - DNA, 50 bp, Homo sapiens
acccgcagaccagatggttgaaaggaaaaattaaagccttcttggggatt

SEQ ID NO: 5091 - DNA, 50 bp, Homo sapiens
ggagttagatcaaccttatggggaagggaaaggcagggcttgtgacaatt

SEQ ID NO: 5092 - DNA, 50 bp, Homo sapiens
gatggctgcttggttgctaaacccagacagggtccttccagtgcatctgc

SEQ ID NO: 5093 - DNA, 50 bp, Homo sapiens
catttgtgggtggagggttttgaatgtcctctttccatgtcaggcaaagg

SEQ ID NO: 5094 - DNA, 50 bp, Homo sapiens
ttctatgaaggtttccctggacaagaaactgccagagagcccttagctca

SEQ ID NO: 5095 - DNA, 50 bp, Homo sapiens
tgctgaatgtacctgagtgtatgtatttaaaaggactcacatgggcatca

SEQ ID NO: 5096 - DNA, 50 bp, Homo sapiens
tctcaaccctaatattcattgttccatgagcattgtcaggttttggatgg

SEQ ID NO: 5097 - DNA, 50 bp, Homo sapiens
acaagtggaagaggaagacagaagaatgggtcagggagatgcaaggatgg

SEQ ID NO: 5098 - DNA, 50 bp, Homo sapiens
tccttagggaaaagaagattttcaaacccttcgttagtttcggtagggcc

SEQ ID NO: 5099 - DNA, 50 bp, Homo sapiens
acgcaatttgttcacatacatacacatgcaaatcccaaaagaaggtttta

SEQ ID NO: 5100 - DNA, 50 bp, Homo sapiens
cccagccctctatgtacccgtgtcccagccagcaataaatgccatcttgg

SEQ ID NO: 5101 - DNA, 50 bp, Homo sapiens
agcctggaattctaagcagcagtttcacaatctgtaattgcacgtttctg

SEQ ID NO: 5102 - DNA, 50 bp, Homo sapiens
tggttactcatgtcctcaaagacgactcatgatgctggatatgaagaact

SEQ ID NO: 5103 - DNA, 50 bp, Homo sapiens
aggcaaaagtcatttcttccctatattttgtcatgcttatctcctgtctc

SEQ ID NO: 5104 - DNA, 50 bp, Homo sapiens
gtatgaaggcaagaaaatttcaggggaaaacaagtggttattttctggcc

SEQ ID NO: 5105 - DNA, 50 bp, Homo sapiens
gataccctcttcctaagactcatcgcgtctcttccagcctcctcgcccca

SEQ ID NO: 5106 - DNA, 50 bp, Homo sapiens
tctgtatgctgtggtctcatcaggaacctttctctgcactgcatttttcc

SEQ ID NO: 5107 - DNA, 50 bp, Homo sapiens
agagctggttccagaaggttcggatgagtcctgaatgtttatgtagggca

SEQ ID NO: 5108 - DNA, 50 bp, Homo sapiens
tccttagtctccttcaatttccacacactgaacatgacattttacccttt

SEQ ID NO: 5109 - DNA, 50 bp, Homo sapiens
ttttctgttttctgttttaagaaaatctggaaccgcaaggccgtcccttt

SEQ ID NO: 5110 - DNA, 50 bp, Homo sapiens
ccaaagcctttgttgtttggtggcgaggcccctttttgaatggggttttt

SEQ ID NO: 5111 - DNA, 50 bp, Homo sapiens
tgccgcccccaggattcttttaagaataaaaagaaatgagtgtggacatg

SEQ ID NO: 5112 - DNA, 50 bp, Homo sapiens
cctacgatatccttttcaaataggggtgggtccagcccccttgtgccctg

SEQ ID NO: 5113 - DNA, 50 bp, Homo sapiens
ctgggagaaaggtactttgggttagtggtagggatagggatgaacgggaa

SEQ ID NO: 5114 - DNA, 50 bp, Homo sapiens
agcataatcctaatgaggaactttgtctgaagtctgaggctgagttactt

SEQ ID NO: 5115 - DNA, 50 bp, Homo sapiens
ttttggaacccttagccctgtgcaaatcaaaggatgtgaggggaaaaagg

SEQ ID NO: 5116 - DNA, 50 bp, Homo sapiens
atttcccctacggatgggaccaagaaactgatgagaacggccaagtgttt

SEQ ID NO: 5117 - DNA, 50 bp, Homo sapiens
aacacccgaaaccgtcttctgtggcatttgtcagttgaaaaagaacacct

SEQ ID NO: 5118 - DNA, 50 bp, Homo sapiens
ccagtggctgggatggtgacagtgacatccacagtaaacagatgaaatgt

SEQ ID NO: 5119 - DNA, 50 bp, Homo sapiens
ggatttcagaaacagttgcagatattattgattagctagttggcagtggg

SEQ ID NO: 5120 - DNA, 50 bp, Homo sapiens
cttgttcccaggccagccccacacagtaggcagtcattaaagtttggtga

SEQ ID NO: 5121 - DNA, 50 bp, Homo sapiens
ttttccttcaactcttgcgactttcttggtctgcctgtgtggttttaata

SEQ ID NO: 5122 - DNA, 50 bp, Homo sapiens
ttctgttaatagcaaacattgcctttgagtgctactactaaacctgaggc

SEQ ID NO: 5123 - DNA, 50 bp, Homo sapiens
tctagggatctgcccggctcaaaatcccaggccgttaggctaagttgttc

SEQ ID NO: 5124 - DNA, 50 bp, Homo sapiens
cggacaagggctggcaggtaaatgccttcagtttgttgttaaatagaggc

SEQ ID NO: 5125 - DNA, 50 bp, Homo sapiens
agccttagcccctttaaagcacttaaagttactacttccaaatgtgattt

SEQ ID NO: 5126 - DNA, 50 bp, Homo sapiens
accttgtcattaacagctcactttgattgaacatctactctgtggcggtt

SEQ ID NO: 5127 - DNA, 50 bp, Homo sapiens
tggaacggctatttgccggtttaaaaaccaaaaaccccggtttttccaaa

SEQ ID NO: 5128 - DNA, 50 bp, Homo sapiens
gtaaggcagacgagagaggcggaggtctcacagtgaaccacaggatctgg

SEQ ID NO: 5129 - DNA, 50 bp, Homo sapiens
ttgcctgccatgcccttataagtgccctttaatgtcatagcatgtaaagg

SEQ ID NO: 5130 - DNA, 50 bp, Homo sapiens
gggtttgtgtccccatttagaatctgatgaaacggtgggctttccttctt

SEQ ID NO: 5131 - DNA, 50 bp, Homo sapiens
cagagcctccagaattatgtgaacttgtctcaaaacattctctaaatggc

SEQ ID NO: 5132 - DNA, 50 bp, Homo sapiens
gaaaggacccgagggtttgtatttaaaaagcctcccctgggcctcaaaaa

SEQ ID NO: 5133 - DNA, 50 bp, Homo sapiens; identical to SEQ ID NO: 4265

SEQ ID NO: 5134 - DNA, 50 bp, Homo sapiens
tgtctagaacagactgagagtgacacgcatatttgattgtgaggacagtt

SEQ ID NO: 5135 - DNA, 50 bp, Homo sapiens
gtttggcccccaaagtgtttaggagagctttctccctagatcgccctgtg

SEQ ID NO: 5136 - DNA, 50 bp, Homo sapiens
ccaggagggccagaatttgaaaattccttggggttgttctttttccaaaa

SEQ ID NO: 5137 - DNA, 50 bp, Homo sapiens
cagtttgagcaaaagcctttgaaatccaagacttttccccttggggtgct

SEQ ID NO: 5138 - DNA, 50 bp, Homo sapiens
ccagttggtttttggactccaaagcccaggacccttccaaatcctgcttg

SEQ ID NO: 5139 - DNA, 50 bp, Homo sapiens
aggcctttttcaaagaaaaacccctttggggaaaaagggaaagggcaaaa

SEQ ID NO: 5140 - DNA, 50 bp, Homo sapiens
ttttgcttgctgtcgggagaataaagcagggaacctttatgtagtgaaaa

SEQ ID NO: 5141 - DNA, 50 bp, Homo sapiens
gggtttggcccgattatattaggttgggtgggggaaaaattttatggggg

SEQ ID NO: 5142 - DNA, 50 bp, Homo sapiens
gtgaactggatcttgaggccgtgctggaaaccggaaggtacactgcttgg

SEQ ID NO: 5143 - DNA, 50 bp, Homo sapiens
caaaacttgagataaggttaaaactgtgcccagaggaaaactggtagtct

SEQ ID NO: 5144 - DNA, 50 bp, Homo sapiens
tgcagccagattgttccaaggttgccaattacctagtgggtaaatttccc

SEQ ID NO: 5145 - DNA, 50 bp, Homo sapiens
agtgcttatcatgaaatgtgcttcactggttcagctctgttgtttcctta

SEQ ID NO: 5146 - DNA, 50 bp, Homo sapiens
gttatttgggagacaaatggacgggcaggaagattgatgctccgctgttc

SEQ ID NO: 5147 - DNA, 50 bp, Homo sapiens
agctgaagggcttcaactttgcttggatttttaaatattttccttgcata

SEQ ID NO: 5148 - DNA, 50 bp, Homo sapiens
tgcaggctcattgtgctccttcttctgggtttcaattggatttcagtcct

SEQ ID NO: 5149 - DNA, 50 bp, Homo sapiens
atctctaatgaagcctaggatcagatttgtggcataccaacagcacatgt

SEQ ID NO: 5150 - DNA, 50 bp, Homo sapiens
ccacaagggttagtttgggccttaaaactgccaaggagtttccaaggatt

SEQ ID NO: 5151 - DNA, 50 bp, Homo sapiens
cgctttattcccacgaaacctaggacagtggccatcaaaccgagcgcttt

SEQ ID NO: 5152 - DNA, 50 bp, Homo sapiens
cctgttgtggctggctgcataataatttccaggaggctttcggaaatgtt

SEQ ID NO: 5153 - DNA, 50 bp, Homo sapiens
cggtccagtcggctgcttccattccctgaagaagaggccctaaagttaaa

SEQ ID NO: 5154 - DNA, 50 bp, Homo sapiens
ttagcctcaaaggggtggggaaaagcccatacctcctgggccagtcctag

SEQ ID NO: 5155 - DNA, 50 bp, Homo sapiens
ccttagaattaagttgaattttcctgccttgctaagcaagacttcctgca

SEQ ID NO: 5156 - DNA, 50 bp, Homo sapiens
cagccacggcccctcgcgtcttcgcggcacgttaattaaatgcggaaaac

SEQ ID NO: 5157 - DNA, 50 bp, Homo sapiens
ttttacccaaattttaaaggccggataaaagggtttttgtttggaaggga

SEQ ID NO: 5158 - DNA, 50 bp, Homo sapiens
ggaggttagggcctgaagctcaaagctccccctttttaatagtttttccc

SEQ ID NO: 5159 - DNA, 50 bp, Homo sapiens
cccctttgggccccccgggttttccctttttggtttcgggttgttttttg

SEQ ID NO: 5160 - DNA, 50 bp, Homo sapiens
acgtgggcctttggaccccttataagatggtcataagaccccaaaactga

SEQ ID NO: 5161 - DNA, 50 bp, Homo sapiens
atggctataaggccaaaaaagtttggcggcatgggggattttttgctctt

SEQ ID NO: 5162 - DNA, 50 bp, Homo sapiens
agagacggccacctgagaccaattagaatatccacaccagtggaagagag

SEQ ID NO: 5163 - DNA, 50 bp, Homo sapiens
gcctccccaacccctggcctcaatttccctttctataaaatggaagatgt

SEQ ID NO: 5164 - DNA, 50 bp, Homo sapiens
acacccagccaaagaaaagcatacctgaatccaagagagtatttacactg

SEQ ID NO: 5165 - DNA, 50 bp, Homo sapiens
ctcagagaagaacagtgtagaaacccgcgctgtgtgaagcgaggttgggc

SEQ ID NO: 5166 - DNA, 50 bp, Homo sapiens
actttccattgttgagctggggagttggattttgtccatttgtttttatg

SEQ ID NO: 5167 - DNA, 50 bp, Homo sapiens
tcccagtgatgattcgctccctttgttaattactcagtgtttcttgtttt

SEQ ID NO: 5168 - DNA, 50 bp, Homo sapiens
tgcgtgctgctaatacttaggtacccataataggtctttacactcagttt

SEQ ID NO: 5169 - DNA, 50 bp, Homo sapiens
cctgaccttgaggcatttttgattgtgcagttacctagggtatgcttgtg

SEQ ID NO: 5170 - DNA, 50 bp, Homo sapiens
gaggactgggaccgtgattccactaaccggaaaccgtcgcctttcgggcc

SEQ ID NO: 5171 - DNA, 50 bp, Homo sapiens
ggggaagtcaaggagacacacacgctctttcaacagaatcagctcttaat

SEQ ID NO: 5172 - DNA, 50 bp, Homo sapiens
aactagatcctgccttagaaaaccttttgccatgaatgacaaattcatgt

SEQ ID NO: 5173 - DNA, 50 bp, Homo sapiens
tgtcagcatctggaatagtgtaagtatgcagtggaggaaatctcatcctt

SEQ ID NO: 5174 - DNA, 50 bp, Homo sapiens
ttaacaggacctctgggccaccaaggagaaagggctggggaagccaagag

SEQ ID NO: 5175 - DNA, 50 bp, Homo sapiens
gttctgtgatagtttgtttcccctcatctccctcacctctgcctgggttg

SEQ ID NO: 5176 - DNA, 50 bp, Homo sapiens
ggcccctccttttgctggagagttttttataaactggagcccgatttcat

SEQ ID NO: 5177 - DNA, 50 bp, Homo sapiens
gggctttttcttcccctaatcagggtgacctgggccttttgggcaggatc

SEQ ID NO: 5178 - DNA, 50 bp, Homo sapiens
aaggaggggagtgaatgatattgctgtcatttctcagcaaatcatagtga

SEQ ID NO: 5179 - DNA, 50 bp, Homo sapiens
taaaattctctgtgggaaaaagcctgccaataaaatgggggtttttgggc

SEQ ID NO: 5180 - DNA, 50 bp, Homo sapiens
acagactaagctggtttggtggattcatctttcacttatgaagaaagcag

SEQ ID NO: 5181 - DNA, 50 bp, Homo sapiens
cccaaagcctggggggtttggcccaaaccttccccctggtttttataaaa

SEQ ID NO: 5182 - DNA, 50 bp, Homo sapiens
actgctttcaagaaagtgggaccagtggcattgtagccaccataatcact

SEQ ID NO: 5183 - DNA, 50 bp, Homo sapiens
gcccttggcaaatgatttgagaccccttttgaaaaccatgtaggatgaat

SEQ ID NO: 5184 - DNA, 50 bp, Homo sapiens
cacacagcagtggcttggggatgaggaaggaagggagaatctcaacggag

SEQ ID NO: 5185 - DNA, 50 bp, Homo sapiens
tttttctgtgagttaggggcatggaggcggcagtgttgggagctggagcc

SEQ ID NO: 5186 - DNA, 51 bp, Homo sapiens
agttggctctagtttaaagatataaatacgtacctcacttaaaccccatgt

SEQ ID NO: 5187 - DNA, 50 bp, Homo sapiens
cttcaggcccaagttcaacgggttaaagaggtccgctcccaaattattct

SEQ ID NO: 5188 - DNA, 50 bp, Homo sapiens
gtcccagtagccccatttcagggcttgctagttacatgggtttgtgttta

SEQ ID NO: 5189 - DNA, 50 bp, Homo sapiens
ggatgtgtgatgtttatatgggagaacaaaaagctgatgtatagccctgt

SEQ ID NO: 5190 - DNA, 50 bp, Homo sapiens
caatttccacctctaagggggtcgggaaaggcacgctgagggtgaatatg

SEQ ID NO: 5191 - DNA, 50 bp, Homo sapiens
gctttcaaatgaatttcagggctttctttgaagcagtcttgtaaagttgt

SEQ ID NO: 5192 - DNA, 50 bp, Homo sapiens
tcctttctggataccaggaatcacttaaaaatctgtgtataatgccccca

SEQ ID NO: 5193 - DNA, 50 bp, Homo sapiens
aaacagggaacgacaggaaaaagatgaccgtgatacactctgctaaaagc

SEQ ID NO: 5194 - DNA, 50 bp, Homo sapiens
cccccccggcttcccccttttttccccgcccgtttttttgggggaatggg

SEQ ID NO: 5195 - DNA, 50 bp, Homo sapiens
ggccatgccgggccagccccacctgaagctcagtgaaagctgattaaaaa

SEQ ID NO: 5196 - DNA, 50 bp, Homo sapiens
cgcaggactctaaagatccaagctcacaaaacactccaaatccacctcga

SEQ ID NO: 5197 - DNA, 50 bp, Homo sapiens
aactttacttctgttcttggcaggacatggagagagggagggattccaaa

SEQ ID NO: 5198 - DNA, 50 bp, Homo sapiens
gggtgataattgagggtgccgctgggaaggtccgagaatgggttttcatg

SEQ ID NO: 5199 - DNA, 50 bp, Homo sapiens
gttcattgctgttcagagtgttgctgctgtggtgctataaatgctcccag

SEQ ID NO: 5200 - DNA, 50 bp, Homo sapiens
tattccaccagtgagctacactcccggcccctttagtgttgtttgtaaac

SEQ ID NO: 5201 - DNA, 50 bp, Homo sapiens
ccgtgttgtggcaaaatggtccctggagtttttgaccctgtgtttaaaga

SEQ ID NO: 5202 - DNA, 50 bp, Homo sapiens
ttttttggggccgaaaacccccaatgagggggattaaagctgttttcccc

SEQ ID NO: 5203 - DNA, 50 bp, Homo sapiens
ggggttgtccttttcccaccctgatggggaatttatggatgggtttcctt

SEQ ID NO: 5204 - DNA, 50 bp, Homo sapiens
aaatgagtgaccaaaacacttctgtaccacttctgtgagctgaggtccag

SEQ ID NO: 5205 - DNA, 50 bp, Homo sapiens
aggaacctaaagaaactgccaagtgtagataagcattgagtatgttaccc

SEQ ID NO: 5206 - DNA, 50 bp, Homo sapiens
ggttgtccagttttcggtttttaacgccccccataggggatttggccccc

SEQ ID NO: 5207 - DNA, 50 bp, Homo sapiens
gttttggaatgaggaatgatttttctaagcctgacatcagatgtctgaca

SEQ ID NO: 5208 - DNA, 50 bp, Homo sapiens
gaaattctccccttttcccctctccttcccttctgctgacctgttctcag

SEQ ID NO: 5209 - DNA, 50 bp, Homo sapiens
cacagagggagtgtgcagggccagatttcatcctggggccacgctgaaat

SEQ ID NO: 5210 - DNA, 50 bp, Homo sapiens
tgataggacatagtagtacgggtggtcagacatgaaaatggtggggagcc

SEQ ID NO: 5211 - DNA, 50 bp, Homo sapiens
caatacctacccccagtggcagccgcctgctcctcatgacccaagtaagt

SEQ ID NO: 5212 - DNA, 50 bp, Homo sapiens
tgttttaacaactcttctcaacattttgtccaggttattccctgtaacca

SEQ ID NO: 5213 - DNA, 50 bp, Homo sapiens
taagtgtcaggtttgtggggaaggttattcttgccttgtgtattttgtcc

SEQ ID NO: 5214 - DNA, 50 bp, Homo sapiens
caaacccctatcccccattctcctcctatccctcaaccccgacatcatta

SEQ ID NO: 5215 - DNA, 50 bp, Homo sapiens
cctgcaacagctaaggccaagccaaacttaccgtggactcaaacactttg

SEQ ID NO: 5216 - DNA, 50 bp, Homo sapiens; identical to SEQ ID NO: 372

SEQ ID NO: 5217 - DNA, 50 bp, Homo sapiens
tcccaccccttttctactgaatttgtggggatcctataataaaagtgaat

SEQ ID NO: 5218 - DNA, 50 bp, Homo sapiens
actaccagagccctaggacttctgagcacatttagaaaataccagaggca

SEQ ID NO: 5219 - DNA, 50 bp, Homo sapiens
catgtcagagttcttaacagaaagcaaaggtttccaacagcacttgcatt

SEQ ID NO: 5220 - DNA, 50 bp, Homo sapiens
atgaaatctcatggggccaaactgcacatcagctactgctaccttcttgc

SEQ ID NO: 5221 - DNA, 50 bp, Homo sapiens
ccctgtggcaacttgtgggtacggtttaactggaccacgctgagcttctg

SEQ ID NO: 5222 - DNA, 50 bp, Homo sapiens
agaaatagtgtttctcggaagctcagtttggagctgactgcacacgttgc

SEQ ID NO: 5223 - DNA, 50 bp, Homo sapiens
gttgctggctgccctcccctgcactctccctgaaataaagaacagcttgg

SEQ ID NO: 5224 - DNA, 50 bp, Homo sapiens; identical to SEQ ID NO: 5223

SEQ ID NO: 5225 - DNA, 50 bp, Homo sapiens
acgtgtcagacacaatcctgagccttctacaagtgttccctcttactcct

SEQ ID NO: 5226 - DNA, 50 bp, Homo sapiens
aagccctgtttacccaggtttttcttaaggcgagaaggtttagggtggtg

SEQ ID NO: 5227 - DNA, 50 bp, Homo sapiens
gagaaagctcccagtctgtctttcccaacatcccttcagtttcaataagc

SEQ ID NO: 5228 - DNA, 50 bp, Homo sapiens
ttcaggtgagtgtgcctggaggtggagaactatggttttgataacttggc

SEQ ID NO: 5229 - DNA, 50 bp, Homo sapiens
aaggtgccatgtattgaaagtgtgcgtcaaagaacataaatatcagtgga

SEQ ID NO: 5230 - DNA, 52 bp, Homo sapiens
tgtaattattttctgtatgttcaagaaggtaaaggaaaggacagctatggga

SEQ ID NO: 5231 - DNA, 51 bp, Homo sapiens
atttatttggggttggtcccccctttgggccccccgggttttccctttttt

SEQ ID NO: 5232 - DNA, 50 bp, Homo sapiens
aaccataaaaggcccgtttggttagttttccctgtttcctggtttgggct

SEQ ID NO: 5233 - DNA, 50 bp, Homo sapiens
ttatggggtaactcactttgggcggcacgaagaactccaggcggaagcgt

SEQ ID NO: 5234 - DNA, 50 bp, Homo sapiens
tctctccccatcccaagtcatccagccctttttcctaccctcaataaacc

SEQ ID NO: 5235 - DNA, 50 bp, Homo sapiens
ccccctgatggacttcaaatatgtctcatcaactacagtattaaatgcca

SEQ ID NO: 5236 - DNA, 50 bp, Homo sapiens
cgagaatgcctagggaaaccagctacgcttacaagccagctacgcagccc

SEQ ID NO: 5237 - DNA, 50 bp, Homo sapiens
ggaaacattggcctgggggtgtcccccaaaagggggccgtttttaaaggg

SEQ ID NO: 5238 - DNA, 50 bp, Homo sapiens
tgggttgacattgttcgcacggggtgtttcttatattaaaaagactcact

SEQ ID NO: 5239 - DNA, 50 bp, Homo sapiens
ctttccacaaaataatcgataaccttgggggattgttttatggcttgaca

SEQ ID NO: 5240 - DNA, 50 bp, Homo sapiens
ccgccttggggagacaggtcttgattgtctttttcccagtgaacattgtt

SEQ ID NO: 5241 - DNA, 50 bp, Homo sapiens
tcccagactttcaggaaagtaactgtagcactgttaatatcacaacaaca

SEQ ID NO: 5242 - DNA, 50 bp, Homo sapiens
ttttagctgggagtggggggactatggggaataactttccttcatttaat

SEQ ID NO: 5243 - DNA, 50 bp, Homo sapiens
acatgtgtgtgttttccatgaggcactgctttttatgcatttccctcccc

SEQ ID NO: 5244 - DNA, 50 bp, Homo sapiens
ctgtatttgaagtcagcagggctcagcaggatttgaccgacagttacctc

SEQ ID NO: 5245 - DNA, 50 bp, Homo sapiens
tggtttatagatgcacttcctttcataggcagtccctggcactttcttgc

SEQ ID NO: 5246 - DNA, 50 bp, Homo sapiens
aggagctggtattattggagggtattatagatccagtgtattgtgactgt

SEQ ID NO: 5247 - DNA, 50 bp, Homo sapiens
gcagtagtgctaaggcgtcttttgtaggctttagattttgtcgttatggc

SEQ ID NO: 5248 - DNA, 50 bp, Homo sapiens
gcttgtcagaacagaagatatttccaccctgcctagtagatgtgtttcag

SEQ ID NO: 5249 - DNA, 50 bp, Homo sapiens
cccccgttttaggttagggccttgggcaggggtttgccccctgttacccc

SEQ ID NO: 5250 - DNA, 50 bp, Homo sapiens
ttggttttatttatccaaaactgagccttctcataggctttacacccgga

SEQ ID NO: 5251 - DNA, 50 bp, Homo sapiens
ggcaggctctagccaccctgtcggttcccaataagccatttattgaataa

SEQ ID NO: 5252 - DNA, 50 bp, Homo sapiens
tttttgaccagtctacatttcgtatctgtgggatctgcatttgtgaattc

SEQ ID NO: 5253 - DNA, 50 bp, Homo sapiens
tctggacaatgttgatgctaaccttgatgatatccatccctattactggg

SEQ ID NO: 5254 - DNA, 50 bp, Homo sapiens
aggacatgaaggtctgaaaaagaaacaggaaaatacagacatccccgctt

SEQ ID NO: 5255 - DNA, 50 bp, Homo sapiens
aagtcaaggaaccctctcgggtctctgagatccaggccaacagtaaacag

SEQ ID NO: 5256 - DNA, 51 bp, Homo sapiens
agggggctttaaaatttaaaaattgccttttgttttaaaaaaggcccatgt

SEQ ID NO: 5257 - DNA, 50 bp, Homo sapiens
ccccctcccacccaaagaaaaagaaatggtaactacctggacaaaacatt

SEQ ID NO: 5258 - DNA, 50 bp, Homo sapiens
cccttggctcttattgttcttgctggtgtggtatgttcccggctgaaaaa

SEQ ID NO: 5259 - DNA, 50 bp, Homo sapiens
ttccccttttttcccccttttttaaaaagccccttttttaaatggggcgc

SEQ ID NO: 5260 - DNA, 50 bp, Homo sapiens
aaggacagcttgcttgctgatgaacacttccacagtcttttgagctaagt

SEQ ID NO: 5261 - DNA, 51 bp, Homo sapiens
acatgagaattaaccatgtccagtagttaagttcattttcctacagtgtgc

SEQ ID NO: 5262 - DNA, 50 bp, Homo sapiens
gccagaatggtacagagtggagggtgttctgctaatgacttcagagaagt

SEQ ID NO: 5263 - DNA, 50 bp, Homo sapiens
gcacaacttctgggaatctagtggctgtatgttaaagcatcggtaaaaga

SEQ ID NO: 5264 - DNA, 50 bp, Homo sapiens
aaaaaggccccttgtttgttggtttttggcccgttggggaaaatgcctgt

SEQ ID NO: 5265 - DNA, 50 bp, Homo sapiens
tttaggagctgaccatacatgatgagtgatacagcctgtactttgctcat

SEQ ID NO: 5266 - DNA, 50 bp, Homo sapiens
ggtttcccacgaacgggaggctgctgaagagtcaaagcctgggcagactc

SEQ ID NO: 5267 - DNA, 50 bp, Homo sapiens
caggtcatgagtattccaagctcaggtggtgagtcctcctcaccgggatg

SEQ ID NO: 5268 - DNA, 50 bp, Homo sapiens
aaagggaaactggctctggcaccacctactggagaccaaacttcaccaaa

SEQ ID NO: 5269 - DNA, 50 bp, Homo sapiens
gacaaaatagttacctatgctttccttctggcaccccgaatgtacgcagg

SEQ ID NO: 5270 - DNA, 50 bp, Homo sapiens
atctgacctgagggagatcacaaatgccttctgtattgggtggtaatgat

SEQ ID NO: 5271 - DNA, 50 bp, Homo sapiens
tccgttgtaacacatctaatgtgaacgcattataaacatggacctgtact

SEQ ID NO: 5272 - DNA, 51 bp, Homo sapiens
acataactattccgttgatgaatagcatcaggacttaaatggtgaccttgt

SEQ ID NO: 5273 - DNA, 51 bp, Homo sapiens
aacgggtttgggtttgggggggtttgttctttttattgaatccatttaagt

SEQ ID NO: 5274 - DNA, 50 bp, Homo sapiens
tataggagatgggatactcattcccgctgctattgataaggtcggaggcg

SEQ ID NO: 5275 - DNA, 50 bp, Homo sapiens
cagaacgtcctcaaggacacactcctccctcgggcctcactctggagcac

SEQ ID NO: 5276 - DNA, 50 bp, Homo sapiens
ctggacatgttgtttccatgttcagtcccttcccggtttttgggtgtttt

SEQ ID NO: 5277 - DNA, 50 bp, Homo sapiens
aaagtagccatcctgagtctccagggtgatgagcggacttgggtgtggat

SEQ ID NO: 5278 - DNA, 50 bp, Homo sapiens
ccttccatctcatcggtggcctctcactgtggctcactgtttaacacatg

SEQ ID NO: 5279 - DNA, 50 bp, Homo sapiens
tgttcaaggtcacatagtttaggtaagaagctcaaacctgagttttaggt

SEQ ID NO: 5280 - DNA, 50 bp, Homo sapiens
cacctgattccccctcttgcccacaggactctgctgttgttttcattctg

SEQ ID NO: 5281 - DNA, 50 bp, Homo sapiens
tctcgtgaggtgatgtggtgctgcagacttaagctatctgccttgaagat

SEQ ID NO: 5282 - DNA, 50 bp, Homo sapiens
aacaagcctggaataatgcccccaaagattgagtggaaatcgcccctttt

SEQ ID NO: 5283 - DNA, 50 bp, Homo sapiens
caggaccagatggcccaggaggaagtggatgctttcttggtagggaatgg

SEQ ID NO: 5284 - DNA, 50 bp, Homo sapiens
cctcctgctagaagacagatttcttccttggctgacaggctgaattaagc

SEQ ID NO: 5285 - DNA, 50 bp, Homo sapiens
aatttccaaaaacaaaacaaaacaagcaggtttcatggagcccgagtcca

SEQ ID NO: 5286 - DNA, 50 bp, Homo sapiens
cctttatgcaagttgtaaggggttgaccagtaaagaggaagttttgcccc

SEQ ID NO: 5287 - DNA, 50 bp, Homo sapiens
agtattagctacaaacaagccttgtttcctcttggctgtcaggcactgct

SEQ ID NO: 5288 - DNA, 50 bp, Homo sapiens
aagccccagtaaggtgttcaggactggtaaacgactgtcctcaagtaagg

SEQ ID NO: 5289 - DNA, 50 bp, Homo sapiens
tggttcaggtagtaaatgcttttggtcacatcagaactctagatctgggg

SEQ ID NO: 5290 - DNA, 50 bp, Homo sapiens
gcctgggctgtttttgctatatgtaaataaagcccttgggtctttatttt

SEQ ID NO: 5291 - DNA, 50 bp, Homo sapiens
ggaggttaggaagcccttttaaagtacaaacccccggcatggggaatttt

SEQ ID NO: 5292 - DNA, 50 bp, Homo sapiens
aacgggagtgatcgggaagtgaacagtttcatcatctgctgctgctattc

SEQ ID NO: 5293 - DNA, 50 bp, Homo sapiens
ctggtatgttgctttgtaggggaaaaactaattttgttgggtcagggaca

SEQ ID NO: 5294 - DNA, 50 bp, Homo sapiens
ccggacaagccatttgatgttctagtttgcaattactccacgcaaagtgg

SEQ ID NO: 5295 - DNA, 50 bp, Homo sapiens
tttgggcatcaacttcaacaactactaccaggacgcctgagggtgctttt

SEQ ID NO: 5296 - DNA, 50 bp, Homo sapiens
tcgaagaaagtacctgtaaatgtagagtaattgcgaagctgtcaggaata

SEQ ID NO: 5297 - DNA, 50 bp, Homo sapiens
tcctagaccctgcattgtgaaatggggcttgaattttagttctgaatttt

SEQ ID NO: 5298 - DNA, 50 bp, Homo sapiens
ctaaagcagtgtctgacctggatttgctgccaatttgtaagctttcatga

SEQ ID NO: 5299 - DNA, 50 bp, Homo sapiens
ggagctgagcagggatgcaaaaccatccagtctgtaagattcacagagac

SEQ ID NO: 5300 - DNA, 50 bp, Homo sapiens
aaacggtgtttgagctgctttgggaaaacccatgttgcagattttcaggt

SEQ ID NO: 5301 - DNA, 50 bp, Homo sapiens
cagagctgtgtttcctcaacaagtgtgcgagcggtcgtgtgcgccatgag

SEQ ID NO: 5302 - DNA, 50 bp, Homo sapiens
aaatcgcttctgtattgttaatagcaatatatgacctctgctgtcctcct

SEQ ID NO: 5303 - DNA, 50 bp, Homo sapiens
gaaaggataatttcgaacccttgcatagtttcggtatgggccgtgccaac

SEQ ID NO: 5304 - DNA, 50 bp, Homo sapiens
ccctcttgaactgcactgcctaagaaatgttggttgcatggagacatatt

SEQ ID NO: 5305 - DNA, 50 bp, Homo sapiens
tctgccttatttggcttggaagagaaaccgataaacactcccgtgctagt

SEQ ID NO: 5306 - DNA, 50 bp, Homo sapiens
aaacagcagaaaagtaatttctggtgaactgatgagaattccctattgca

SEQ ID NO: 5307 - DNA, 50 bp, Homo sapiens
aggttgttttggaaaaattatttgttttgtcctaaggggtcctgcccacc

SEQ ID NO: 5308 - DNA, 52 bp, Homo sapiens
cctccggaacgtttttaaaaaggaaaaagcccgggttttcccttgggaaaaa

SEQ ID NO: 5309 - DNA, 50 bp, Homo sapiens
cagacctgtgggctgattccagactgagagttgaagttttgtgtgcatca

SEQ ID NO: 5310 - DNA, 50 bp, Homo sapiens
accaagtttgaatttgtcaaatcccaagtcaatccaggatgttcatttct

SEQ ID NO: 5311 - DNA, 50 bp, Homo sapiens
agtgatctgcctttcagcaactgtcttattttggttctttgaaactgtga

SEQ ID NO: 5312 - DNA, 50 bp, Homo sapiens
tttgaatggctgaagctaaggcaacgttagtttctccttactctgctttt

SEQ ID NO: 5313 - DNA, 50 bp, Homo sapiens
acctttgtgattctgtctagtgaaaatgggacatttttaatagtgccaga

SEQ ID NO: 5314 - DNA, 50 bp, Homo sapiens
gaacttgcccctaaactgggttaaatggaccctgttgagttttctggaca

SEQ ID NO: 5315 - DNA, 50 bp, Homo sapiens
taaattgggcaaagttttttatggaatttccggggcaaggttttgggggc

SEQ ID NO: 5316 - DNA, 50 bp, Homo sapiens
aaatctcatttgcaagttctcccattaagcaagggagtagtttactagga

SEQ ID NO: 5317 - DNA, 50 bp, Homo sapiens
aagaaaggcccataacagatggcaaaatagaggattggtgagggatatgc

SEQ ID NO: 5318 - DNA, 50 bp, Homo sapiens
aaaaccattccagcttaatgcctttaattttaatgccaacaaaattgggg

SEQ ID NO: 5319 - DNA, 50 bp, Homo sapiens
tgcaaccttcttaaaatgtgggctactggagatcatgccactgcactcca

SEQ ID NO: 5320 - DNA, 50 bp, Homo sapiens
agctcagatgggtccccaaaagaggcataggaaagcgcgacctcactgcc

SEQ ID NO: 5321 - DNA, 50 bp, Homo sapiens
caaataaaaaggctggggccaaaggtgggcaccaaaagtcctcctatgtg

SEQ ID NO: 5322 - DNA, 50 bp, Homo sapiens
tgcagctcccatttcctgagcgtctaccaggtactaggagaactcttaca

SEQ ID NO: 5323 - DNA, 50 bp, Homo sapiens
attatccttttccccaggaagccctcggcccccaaaaagggaaacagttt

SEQ ID NO: 5324 - DNA, 50 bp, Homo sapiens
catgagcccaggggtttcatgacaaacattactagcatgttcaactgccc

SEQ ID NO: 5325 - DNA, 50 bp, Homo sapiens
gcccggtttatggaaaaaccaggaccagtttatgtttggggttttgggaa

SEQ ID NO: 5326 - DNA, 50 bp, Homo sapiens
gcttggtactgtcatagtgattacaaatttcatggaatgcgaagagcaac

SEQ ID NO: 5327 - DNA, 50 bp, Homo sapiens
ttttctcccctctcttccccttccacgaactgcaataccagtaaccttgg

SEQ ID NO: 5328 - DNA, 50 bp, Homo sapiens
aagcccagatacacaaaattccaccccatgatcaagaatcctgctccact

SEQ ID NO: 5329 - DNA, 50 bp, Homo sapiens
catgtgttgactctgtaatggatttatgtagcccacttcagtctgcaaat

SEQ ID NO: 5330 - DNA, 50 bp, Homo sapiens
aggggtgtcccttttccccttcatgtaaaattctaactggggctaccagt

SEQ ID NO: 5331 - DNA, 50 bp, Homo sapiens; identical to SEQ ID NO: 4387

SEQ ID NO: 5332 - DNA, 50 bp, Homo sapiens
tgaagaaactgccctttctgtgatgtttttgaatactacccaacagccaa

SEQ ID NO: 5333 - DNA, 50 bp, Homo sapiens
cttcctagccctaagtttggcctttgggtggctccaaaaaggattaggtt

SEQ ID NO: 5334 - DNA, 50 bp, Homo sapiens
tccccctcgttttgtagggtttgtacataataaaacaatggggtggggcc

SEQ ID NO: 5335 - DNA, 50 bp, Homo sapiens
tgttaagtgtgaggttttctgaacccttagcagaaggacttttaatgttt

SEQ ID NO: 5336 - DNA, 50 bp, Homo sapiens
agttccactgctgttcctcttaccttgattaaatgcctatgcatgtactt

SEQ ID NO: 5337 - DNA, 50 bp, Homo sapiens
agttctgttgtgtaatctggtgctggttccctgggcatatgtattctgtg

SEQ ID NO: 5338 - DNA, 50 bp, Homo sapiens
cccccttgcttggttttaagtaggtatggaatgttattataggccatagt

SEQ ID NO: 5339 - DNA, 50 bp, Homo sapiens
tcagtgtaaacataattaggccgtgagtttttgctcttactcccaggttt

SEQ ID NO: 5340 - DNA, 50 bp, Homo sapiens
tgtaaacttgttttaacaactcttttcaacattttggccggggtattccc

SEQ ID NO: 5341 - DNA, 50 bp, Homo sapiens
tgctgaaagtggtcccaaaggggtactagtttttaagctcccaactcccc

SEQ ID NO: 5342 - DNA, 50 bp, Homo sapiens
ttcccagttgccacagaccgtttatatgaagaaatgctaaagaagttccc

SEQ ID NO: 5343 - DNA, 50 bp, Homo sapiens; identical to SEQ ID NO: 4387

SEQ ID NO: 5344 - DNA, 51 bp, Homo sapiens
agttctaaagccgggaattcctaaggatatactaaatgagattatgtgtgg

SEQ ID NO: 5345 - DNA, 50 bp, Homo sapiens
gcctgggggaggagaagtcccttcccattccagctcgatcaatcttgctg

SEQ ID NO: 5346 - DNA, 50 bp, Homo sapiens
ggagtagagagagtcttgctacatgcgggaactagaattacatcactgcg

SEQ ID NO: 5347 - DNA, 50 bp, Homo sapiens
aagaagtttcattgatatccactggtcacatcatacctgtctatagggca

SEQ ID NO: 5348 - DNA, 50 bp, Homo sapiens
tgcttcaagcacaggatttatggaatagttggcaaattaaacaacatgct

SEQ ID NO: 5349 - DNA, 50 bp, Homo sapiens
cggcagccttatggaatgagtttcttgtcatgaatgttgtccccaaagct

SEQ ID NO: 5350 - DNA, 50 bp, Homo sapiens
acagttactttggagctgctagactggttttctgtgttggtaaattgcct

SEQ ID NO: 5351 - DNA, 50 bp, Homo sapiens
tgtgaagaatccctaccattaataccctgggtgggataaataaaaatggg

SEQ ID NO: 5352 - DNA, 50 bp, Homo sapiens
cccaaaatttgtttaaagttccgacttccaaaaggggccaataaaaaggg

SEQ ID NO: 5353 - DNA, 51 bp, Homo sapiens
caccgcctctgcctccgcctcttccactggagagcccgaggtcaaaaggtc

SEQ ID NO: 5354 - DNA, 50 bp, Homo sapiens
ccctcacctagcagtactaccacaataatgctatcatggtgccagggaat

SEQ ID NO: 5355 - DNA, 50 bp, Homo sapiens
tctccttccccattgggccgcctttatcaattgcctgttttgttttgttt

SEQ ID NO: 5356 - DNA, 50 bp, Homo sapiens
tttttatctttcttggtgggggtgtggtggtggtgaagaggacctaaaaa

SEQ ID NO: 5357 - DNA, 50 bp, Homo sapiens
cgccagaggtcagaacatgtctattttgaattggatcgttacaaatgagc

SEQ ID NO: 5358 - DNA, 50 bp, Homo sapiens
gcaggcactgacatttttgagcaaagacgtgatgttatgagataaatatc

SEQ ID NO: 5359 - DNA, 50 bp, Homo sapiens
ttctgacacgattacacaacgaggctttaatgccatttgggtaggtgagc

SEQ ID NO: 5360 - DNA, 51 bp, Homo sapiens
ttttaaaggggaggggccggggtttggtccccggtcccaaaggtaaaagtt

SEQ ID NO: 5361 - DNA, 50 bp, Homo sapiens
gagtgagaagaggcttttaaggaccatgtgaagaggcttttaaacacttt

SEQ ID NO: 5362 - DNA, 50 bp, Homo sapiens
gggttgggataaactgcttagatgtttgcctacttgtccagtgaaattac

SEQ ID NO: 5363 - DNA, 50 bp, Homo sapiens
actgaaaagttgaaagacttttgcagtgaacatttatataactccccgct

SEQ ID NO: 5364 - DNA, 50 bp, Homo sapiens
attcataggtagtgcccagagagagtacaagctctgactcatatggcagt

SEQ ID NO: 5365 - DNA, 50 bp, Homo sapiens
acatgttacctggagtagctgtgtcaacagattaatatggaatgctacta

SEQ ID NO: 5366 - DNA, 50 bp, Homo sapiens
tggttcctgtgctcaccatagggctggtgtacattgggccattaataaac

SEQ ID NO: 5367 - DNA, 50 bp, Homo sapiens
acagatccctattgccagacacatcattctctccatccagaaagcaaaca

SEQ ID NO: 5368 - DNA, 50 bp, Homo sapiens
tctgggaaagacatttttaagctgctgacttcacctgcaaaatctaacag

SEQ ID NO: 5369 - DNA, 50 bp, Homo sapiens
agtcacgataaacctggtcacctgaaaattgaaattgagccacttccttg

SEQ ID NO: 5370 - DNA, 50 bp, Homo sapiens
aaactggcggcccaacaaaacagtgggttaaatgggtccctgggtgacat

SEQ ID NO: 5371 - DNA, 50 bp, Homo sapiens
agtgtttcctccacatctaaagaaagcccattttgaaactggatactgca

SEQ ID NO: 5372 - DNA, 50 bp, Homo sapiens
cccaggtggcccctctccatcagatgttattgctcttccccatttattta

SEQ ID NO: 5373 - DNA, 50 bp, Homo sapiens
aagatgcctaagcgttaaccaggtgaaacaggggtgggagagagaaagaa

SEQ ID NO: 5374 - DNA, 50 bp, Homo sapiens
gtcatacacctatcccccattttcctcctatccctcaacccggacatcat

SEQ ID NO: 5375 - DNA, 50 bp, Homo sapiens
gcaggtggcagaatggggtgcatgaaggtttctgaaaattaacactgctt

SEQ ID NO: 5376 - DNA, 50 bp, Homo sapiens
acagagaggcagcatttgttttccagttaaaatttgacctcactgtgatt

SEQ ID NO: 5377 - DNA, 50 bp, Homo sapiens
cccccttttgttgtggttttatattggaaccccctttttctttggaacta

SEQ ID NO: 5378 - DNA, 50 bp, Homo sapiens
ctgaccccttcctcacccctgccaacagtggtggcatatatcacaaatgg

SEQ ID NO: 5379 - DNA, 50 bp, Homo sapiens
tgttttacctcactgttggacatacattccaagcttttcaactctaggag

SEQ ID NO: 5380 - DNA, 50 bp, Homo sapiens
cagaacatgcccaaagaagcctatatcttgctgctgggaaatgtaaagca

SEQ ID NO: 5381 - DNA, 50 bp, Homo sapiens
caaacaccggcagttgaaaggaaaaggacggggaatgtgatggaaaagag

SEQ ID NO: 5382 - DNA, 50 bp, Homo sapiens
ccccctccctgccccggtgagctttggggaacccaaaaattagattttgc

SEQ ID NO: 5383 - DNA, 50 bp, Homo sapiens
cccaaatccaaggaccaatgctgttgtaaacaaggggtaaagggcctaaa

SEQ ID NO: 5384 - DNA, 50 bp, Homo sapiens
actccaccaagactgtgaactccaccggggtaggaagcatattttactca

SEQ ID NO: 5385 - DNA, 50 bp, Homo sapiens
gagaactcgtttcaaggaactcgatgtttccggggaccaagcccgcccag

SEQ ID NO: 5386 - DNA, 50 bp, Homo sapiens
ccagcgaatttccagcttttgaaactcagatttccttttgcgacccaggt

SEQ ID NO: 5387 - DNA, 50 bp, Homo sapiens
gatgcgcggcaagaatgtacctgtagatgtgtacataccacagtgctgta

SEQ ID NO: 5388 - DNA, 50 bp, Homo sapiens
tttatctcagaatcttgatgaactctgaaatgacccctgatgggggcatg

SEQ ID NO: 5389 - DNA, 50 bp, Homo sapiens
ggccccctgtccttacctgttttcggcccccttaattttttaaccccggg

SEQ ID NO: 5390 - DNA, 50 bp, Homo sapiens
gtcacagtgtagacacatggtgcttccatagtgagtagaatatccattgt

SEQ ID NO: 5391 - DNA, 50 bp, Homo sapiens
gtggcctggcctggctctcacagacccaaggcttccgtgtagaatatgtc

SEQ ID NO: 5392 - DNA, 50 bp, Homo sapiens
ggattgtggcaggaactgtttcccctcccagccttaaatttttctgtgtt

SEQ ID NO: 5393 - DNA, 50 bp, Homo sapiens
aaacccacacctcagtgaatttaaaagagtagatgttttaaaagaccgga

SEQ ID NO: 5394 - DNA, 51 bp, Homo sapiens
tgccatttggtattttttcctgaaacattacataataagaatgcagcatgc

SEQ ID NO: 5395 - DNA, 50 bp, Homo sapiens
gcctgaaaccatcctgccttctaggaagacagcaattctggaagagcaag

SEQ ID NO: 5396 - DNA, 50 bp, Homo sapiens
ggtggttccccagcccttttccctggccctgggttggaaaatttgttttc

SEQ ID NO: 5397 - DNA, 51 bp, Homo sapiens
aaaacctttcgcccggcttaaaatttaccggggtttggttttatttggttt

SEQ ID NO: 5398 - DNA, 50 bp, Homo sapiens
ctccttggtgtcatgcaactgaggaacctaattggctgggtgggttgttc

SEQ ID NO: 5399 - DNA, 50 bp, Homo sapiens
gtttgtaaaagaacctgccacatttgttgaaaagttagagccatcacagc

SEQ ID NO: 5400 - DNA, 50 bp, Homo sapiens
ctcttggctgctggccttttgttcttgtcatggctcattagctccctaaa

SEQ ID NO: 5401 - DNA, 50 bp, Homo sapiens
ccaggggtttttaaattttctgaagtttttggggccattttggttgttgg

SEQ ID NO: 5402 - DNA, 50 bp, Homo sapiens
ccccgcttgccttttatttcagaaccccaagtattacccaatatgttaca

SEQ ID NO: 5403 - DNA, 50 bp, Homo sapiens
gccgaagctcacagaggctaagttacacgcttaggtgttcttattcctac

SEQ ID NO: 5404 - DNA, 50 bp, Homo sapiens
aaccaggtttatgatgctgtaataaaccatggcattaaagagggcaagag

SEQ ID NO: 5405 - DNA, 50 bp, Homo sapiens
gggttaaggagggccgctccaaaattttcctttttcccaggaagcccttg

SEQ ID NO: 5406 - DNA, 50 bp, Homo sapiens
atgctgtgagtggtacacatggctgaggttatgatctgttaaaatatgta

SEQ ID NO: 5407 - DNA, 50 bp, Homo sapiens
ttcattaattcctcaacccaatactgtctggcttccaccaacaggagcgg

SEQ ID NO: 5408 - DNA, 50 bp, Homo sapiens
tggtttctattttaaaaacctgggttaggccaaggtttggggttcgccct

SEQ ID NO: 5409 - DNA, 50 bp, Homo sapiens
caacattgcctaccagttgcagttcattagccccgtccgccccagcattg

SEQ ID NO: 5410 - DNA, 50 bp, Homo sapiens
cctttggggtgggggctttttcctttttggccggttcaattaaggttttt

SEQ ID NO: 5411 - DNA, 50 bp, Homo sapiens
cccactccggctgttttagaagttttcccgaatccgtgatccctttacaa

SEQ ID NO: 5412 - DNA, 50 bp, Homo sapiens
aatgggcaaattttacccaaaacttaagcttgcctattccgtttgaggca

SEQ ID NO: 5413 - DNA, 50 bp, Homo sapiens
gaaggagaggcacacacaaatacacacactcacacaaaactcaacaacca

SEQ ID NO: 5414 - DNA, 50 bp, Homo sapiens
ggataccccctttatcccgagggaatttttaccctttggatgcctttaaa

SEQ ID NO: 5415 - DNA, 50 bp, Homo sapiens
caaattacaaacctaaaaatacagaacatcagcggagaagacaggagagc

SEQ ID NO: 5416 - DNA, 50 bp, Homo sapiens
ctcctcccttgggtgggacctgggttgggggtttgatagaaaaattaacc

SEQ ID NO: 5417 - DNA, 50 bp, Homo sapiens
ggttaaactagatccctgcaaggccatcacctccattccaagttgttact

SEQ ID NO: 5418 - DNA, 50 bp, Homo sapiens
agtgggttattttagatcttttcctggggttcaggtcacatagcttaact

SEQ ID NO: 5419 - DNA, 50 bp, Homo sapiens
tgtttgggtatattgtttgggttttgggcactaggatgggtgactcaggg

SEQ ID NO: 5420 - DNA, 50 bp, Homo sapiens
gccagtgaatctagttttggctattctgtattttgtccagtttttcccat

SEQ ID NO: 5421 - DNA, 50 bp, Homo sapiens
aaccattttcccccgggaacccgttttgcctggtttcggattttttaccc

SEQ ID NO: 5422 - DNA, 50 bp, Homo sapiens
ccgggaagcggggtactggctgtgtttaatcattaaaggtaccgtgtccg

SEQ ID NO: 5423 - DNA, 50 bp, Homo sapiens
tttttccccctcccaaattcactgcattacagtttttgaaacagaacggg

SEQ ID NO: 5424 - DNA, 50 bp, Homo sapiens
tacgagaagtcaggaagttttgaaatggcagtgacaggagacgggggaag

SEQ ID NO: 5425 - DNA, 50 bp, Homo sapiens
aagggcaggcaaatcaattaaaattagccgtaacaacaacctcgggggtg

SEQ ID NO: 5426 - DNA, 50 bp, Homo sapiens
agtacacggccctcaaaagttatatgtgctgaatgtaacctacttagcga

SEQ ID NO: 5427 - DNA, 51 bp, Homo sapiens
ttgttttaacaactcttctcaacattttgtccaggttattcactgtaacca

SEQ ID NO: 5428 - DNA, 50 bp, Homo sapiens
cttctccacctcggccaggtatagggccagcttctcgtctctgggatccg

SEQ ID NO: 5429 - DNA, 50 bp, Homo sapiens
gccaggtcattgtatagggagtaagatgaaggtgaatttgcagctagttg

SEQ ID NO: 5430 - DNA, 50 bp, Homo sapiens
tgtgttttgtttttctggtcccagggcaccgtttgttttgtgaactcctc

SEQ ID NO: 5431 - DNA, 50 bp, Homo sapiens
catggctctaaaatttggaattaacttctcttgccttaagagctgcttgt

SEQ ID NO: 5432 - DNA, 50 bp, Homo sapiens
gctggtgggaagttgagccatgtttatctctagtggaatccttaccttgt

SEQ ID NO: 5433 - DNA, 50 bp, Homo sapiens
catgtttacacaaattccttcaaagccccttaaacatggggccgggcccc

SEQ ID NO: 5434 - DNA, 50 bp, Homo sapiens
accctaatagctaggctgggtatattttcaaagtgtagcgaaaccccacg

SEQ ID NO: 5435 - DNA, 50 bp, Homo sapiens
cagttggcctcctacaattgggaattctaccaagctccaagttgacctgg

SEQ ID NO: 5436 - DNA, 50 bp, Homo sapiens
ggattcccgacaaaggcttgatgtgtacttgaagtgagcaaagggttttg

SEQ ID NO: 5437 - DNA, 50 bp, Homo sapiens
gggtgggagacaggctaatcctttccccttgttttccacgtctttatgac

SEQ ID NO: 5438 - DNA, 51 bp, Homo sapiens
acaaccttcttaatatattagagacccgcaggaaacatttagtggtgaaac

SEQ ID NO: 5439 - DNA, 51 bp, Homo sapiens
gtacatgtttgtgtgctaaattgctcatttggcagtgatagattgaaaaac

SEQ ID NO: 5440 - DNA, 50 bp, Homo sapiens
gggggtcaaagagggtacaaatgtatgggggtatattgaatgctaaacat

SEQ ID NO: 5441 - DNA, 50 bp, Homo sapiens
gggagcccgttttagaaggaagggcaaaagtagggtttttaacccaaacg

SEQ ID NO: 5442 - DNA, 50 bp, Homo sapiens
tccgtcccattcccccggaaaacaaggttttgaattggcccgtaaaaggg

SEQ ID NO: 5443 - DNA, 50 bp, Homo sapiens
acgtccttatacaatgcactgtttgatttttaaacaatacctgaagggct

SEQ ID NO: 5444 - DNA, 50 bp, Homo sapiens
actcaatactcgggaaaggcttcacatttctgggactcagcattatccaa

SEQ ID NO: 5445 - DNA, 50 bp, Homo sapiens
ttgagaggcaacacttaaacactagggctactgtggcatctatgtagaca

SEQ ID NO: 5446 - DNA, 50 bp, Homo sapiens
agccctttcttgttgctgtatgtttagatgctttccaatcttttgttact

SEQ ID NO: 5447 - DNA, 50 bp, Homo sapiens
ggggtatggtttagtaatatccaccagaccttccgatccagcagtttggt

SEQ ID NO: 5448 - DNA, 50 bp, Homo sapiens
aacaacaacagcaaaatccccttagtgcgtaacttgaaattcccttcggc

SEQ ID NO: 5449 - DNA, 50 bp, Homo sapiens
ttgtaagtgggtgcataagaagatctcttcaattaaatgcccccgctggt

SEQ ID NO: 5450 - DNA, 50 bp, Homo sapiens
ataattaagaaatcagccgtgtgcttctcacgtttgggctccgagacgtg

SEQ ID NO: 5451 - DNA, 50 bp, Homo sapiens
gtcagtctcctcacctgcctctgctcctcgcttagcccattgattgcatc

SEQ ID NO: 5452 - DNA, 50 bp, Homo sapiens
gggaagaagcccgtgcccccacccaataaatgttggttttggccctgatg

SEQ ID NO: 5453 - DNA, 50 bp, Homo sapiens
cagaacttctggcgaaggccatgtaagaactactccaaggaggaagaggc

SEQ ID NO: 5454 - DNA, 50 bp, Homo sapiens
ctctaccataaggcactatcagagactgctactggagtgtatatttggtt

SEQ ID NO: 5455 - DNA, 50 bp, Homo sapiens
actgctacagcttaaccattgttccaagctaattaaattacctttgggga

SEQ ID NO: 5456 - DNA, 50 bp, Homo sapiens
caattgtgatttggaaggtttaactgggtctgcccagatgtttacgaata

SEQ ID NO: 5457 - DNA, 50 bp, Homo sapiens
tccaagcaaaagttatgcaataagacagaatataaagtctccgagagcct

SEQ ID NO: 5458 - DNA, 50 bp, Homo sapiens
gggtggggtggggtgagagtgtgtggagtaaggaccttcagaattaatat

SEQ ID NO: 5459 - DNA, 51 bp, Homo sapiens
tgcagttcttattttcttttgcctgtgataattgcaaatccgtcaatagaa

SEQ ID NO: 5460 - DNA, 50 bp, Homo sapiens
tgcaagtttctgagactgtgaaaagtgttttgcttcttttgttacccaat

SEQ ID NO: 5461 - DNA, 50 bp, Homo sapiens
tcccagcgaatgtgaatcatttagtgtgctactcaaaattaggtgtccac

SEQ ID NO: 5462 - DNA, 50 bp, Homo sapiens
taagatgtaggggccaccggccagcagtacccagcaatgaccactatcag

SEQ ID NO: 5463 - DNA, 50 bp, Homo sapiens
ataaatgaaagcataccaagtgctgtccattccataggtacaactatgga

SEQ ID NO: 5464 - DNA, 50 bp, Homo sapiens
ctggtattctgaggtcagatgtaggctgttgctcgctccggctgggtctc

SEQ ID NO: 5465 - DNA, 50 bp, Homo sapiens
ccatcgggggtattggggttttgggctgaatttacttgattattggaaaa

SEQ ID NO: 5466 - DNA, 50 bp, Homo sapiens
gccagattgtggcaggtaaagagacaatgtaatttgcactccctatgata

SEQ ID NO: 5467 - DNA, 50 bp, Homo sapiens
tttaaaaaggagggaggatttctgggttaaaacttttatttggcccccat

SEQ ID NO: 5468 - DNA, 50 bp, Homo sapiens
taaaacccaagacttcagattcagccgaattgtggtgtttcacaaggccg

SEQ ID NO: 5469 - DNA, 50 bp, Homo sapiens
ctaagcatggggaagggggcagagtgaggactgtgccattgattaaagtg

SEQ ID NO: 5470 - DNA, 50 bp, Homo sapiens
gtacagaaacatattccatgctttgaaataaagggaagtgctctcctgtt

SEQ ID NO: 5471 - DNA, 50 bp, Homo sapiens
gaagccttttcttttctgttcaccctcaccaagagcacaacttaaatagg

SEQ ID NO: 5472 - DNA, 51 bp, Homo sapiens
accgatcgtttttaggataatatgcatgtttcaagtggtattgaaaccccc

SEQ ID NO: 5473 - DNA, 50 bp, Homo sapiens
tgagggacaggctgcctaaagtctaattggagagttaacctaatgtctgt

SEQ ID NO: 5474 - DNA, 50 bp, Homo sapiens
caccatcgtggctctgagaactgacgccgtgaatgttgacctgagtgccg

SEQ ID NO: 5475 - DNA, 50 bp, Homo sapiens
ggggagagaccaccctagacatttgcatttttgtaagttagccagccaat

SEQ ID NO: 5476 - DNA, 50 bp, Homo sapiens
tggataaatctgagcaactttcttctttgtgctccaggaacctacgcact

SEQ ID NO: 5477 - DNA, 50 bp, Homo sapiens
tgtgggttttgattgacatactgttgttcatgctgaagtttgagtgtcgt

SEQ ID NO: 5478 - DNA, 50 bp, Homo sapiens
ggtgtgcagtccgcctgaaagccttccctttagctattaggaattgagtc

SEQ ID NO: 5479 - DNA, 53 bp, Homo sapiens
acattggaaagaaaccctacaactgtaatgaatatgaaaagaattgtctaaaa

SEQ ID NO: 5480 - DNA, 50 bp, Homo sapiens
aaaaccgttttccccatacataaagaacaggggtactcccgccctgatgg

SEQ ID NO: 5481 - DNA, 50 bp, Homo sapiens
tttggtgaagtgaaagagagaagttgctctaaaaggttggaaaccagccc

SEQ ID NO: 5482 - DNA, 50 bp, Homo sapiens
tggactgttgtaatgttttgcgttatcaaaatgaaaactgccaaatgaga

SEQ ID NO: 5483 - DNA, 50 bp, Homo sapiens
gctttgagttttgggatggtcacatgacacaatccagcacttgaacctga

SEQ ID NO: 5484 - DNA, 50 bp, Homo sapiens
agagccattcccacaaagtaaatgtgcagtgcccatgtttcttgtgttta

SEQ ID NO: 5485 - DNA, 50 bp, Homo sapiens
gactctgagagagagcgacggccatcatagaacagcgaaggcagtcgatc

SEQ ID NO: 5486 - DNA, 50 bp, Homo sapiens
atcgatgagaagagtctgcaaaacacttcatcctcaggacgtgctgtcct

SEQ ID NO: 5487 - DNA, 50 bp, Homo sapiens
atatattaaaccacaggtattagagacatgaattgcacccaacacaagct

SEQ ID NO: 5488 - DNA, 50 bp, Homo sapiens
attcattcgggtcttcctttcttccgcccccttccttccattggcacctc

SEQ ID NO: 5489 - DNA, 50 bp, Homo sapiens
tcagttttgtggaatctggtgtttgcactataggttaagagttgccattt

SEQ ID NO: 5490 - DNA, 50 bp, Homo sapiens
tgtgtggtgggggtgcttttgaggttggaggaaagtagagacagcgaaac

SEQ ID NO: 5491 - DNA, 50 bp, Homo sapiens
tgtgctttttgcccaagtggtaattcatcttggtttgctatgttaaaact

SEQ ID NO: 5492 - DNA, 50 bp, Homo sapiens
ctttggggacctaaaccccaggtggtctcttggtgttaataatgctggaa

SEQ ID NO: 5493 - DNA, 50 bp, Homo sapiens
aaatcgcggtcgccttaatccaagcctaggttttcacacttttagtaagc

SEQ ID NO: 5494 - DNA, 50 bp, Homo sapiens
tggggcactttgaaaacttcacaggcccactgctgcttgctgaaataaaa

SEQ ID NO: 5495 - DNA, 50 bp, Homo sapiens
gacattcatctgtttccactgagtctgagtcttcaagttttcactccagc

SEQ ID NO: 5496 - DNA, 50 bp, Homo sapiens
tggcgaggataaatagaggcattgtttttgctactttgcatatcattggc

SEQ ID NO: 5497 - DNA, 50 bp, Homo sapiens
tggctctcctctttgtaatatacagggtgaactctttactgatacacaca

SEQ ID NO: 5498 - DNA, 50 bp, Homo sapiens
ccagtgtcctgcatgggtgctaggctgaattatttgtaattgtgcttagg

SEQ ID NO: 5499 - DNA, 50 bp, Homo sapiens
accgtcttttgtgattccctggaaacccttaattcaatagtcctgactga

SEQ ID NO: 5500 - DNA, 50 bp, Homo sapiens
agccctgggtagccaagtgattttcccattcccaaagttagtaaaccttt

SEQ ID NO: 5501 - DNA, 50 bp, Homo sapiens
gcaggaaagatggggtggtggactgtttttgcctactttttgtttttgaa

SEQ ID NO: 5502 - DNA, 50 bp, Homo sapiens
ccccctgaaactggcattttgtaaatgtggtttgactatttttgtatgtt

SEQ ID NO: 5503 - DNA, 50 bp, Homo sapiens
acctggagaattccctaaggccaaagcaaggtaacagggacttcagtttt

SEQ ID NO: 5504 - DNA, 50 bp, Homo sapiens
gcctcagtacaaagggggctttggaagtgtttgttggctgaataaaggaa

SEQ ID NO: 5505 - DNA, 50 bp, Homo sapiens
acccatgccaattgaagaacgtgttaaagatgaggaggagagatgtacca

SEQ ID NO: 5506 - DNA, 50 bp, Homo sapiens
gcacattccttccttatatcctggaagcacccagatattcttcatgtccc

SEQ ID NO: 5507 - DNA, 50 bp, Homo sapiens
ttaagtcatctgctgagcagtgtgctgtgtcaacctcctcctaggtaacc

SEQ ID NO: 5508 - DNA, 50 bp, Homo sapiens
cagggtatcagatattgtgccttttggtgccaggttcaaagtcaagtgcc

SEQ ID NO: 5509 - DNA, 50 bp, Homo sapiens
tggtaatagtgtttgactccagggaagaacagatgggtgccagagtgaaa

SEQ ID NO: 5510 - DNA, 50 bp, Homo sapiens
tcaagtataccatttaaaatatttcatcaggcagagccctgaccaggaaa

SEQ ID NO: 5511 - DNA, 50 bp, Homo sapiens
cttttccggttgcccgaggatgcttgggaaggaacccgtctcccttcttc

SEQ ID NO: 5512 - DNA, 50 bp, Homo sapiens
tccccaaacccccttaaaggtttttaaattgtttcaaatctgggcaagtt

SEQ ID NO: 5513 - DNA, 50 bp, Homo sapiens
gactcggagagccaggaggagaacacgcagctctgaactggctgagcgag

SEQ ID NO: 5514 - DNA, 50 bp, Homo sapiens
ctgttgtgaatcatttgtgtccttttcaactgtctttcagaggaaaggta

SEQ ID NO: 5515 - DNA, 50 bp, Homo sapiens
aagaagcaaccacagctaattttagaacatgcactctgacagaaaagaca

SEQ ID NO: 5516 - DNA, 50 bp, Homo sapiens
gcttttgaggacctttctggaggaaaggaaaagcctgttttggggagtct

SEQ ID NO: 5517 - DNA, 50 bp, Homo sapiens
aggctgcatatggattgccaagtcagcatatgaggaattaaagacattgt

SEQ ID NO: 5518 - DNA, 50 bp, Homo sapiens
aagactagagctacactaggccactatcttattacacgacagcacaacat

SEQ ID NO: 5519 - DNA, 50 bp, Homo sapiens
ttaagaaccccaaagattaaaggaaacaatgttaagggcttttgtgagga

SEQ ID NO: 5520 - DNA, 50 bp, Homo sapiens
cggaagtcgaaatcaaatctatgcttttaattgaaaccgtgcctgaaacg

SEQ ID NO: 5521 - DNA, 50 bp, Homo sapiens
tcttcaccaggttcaagctccgtgggccacactgctgctgtgccaagaag

SEQ ID NO: 5522 - DNA, 50 bp, Homo sapiens
gatacactgtccagcccaggtccaggccctaggttctttactctagctac

SEQ ID NO: 5523 - DNA, 50 bp, Homo sapiens
tggaatttactaaattgtgaaattaacgtaaccgaagcaacaaccggcaa

SEQ ID NO: 5524 - DNA, 50 bp, Homo sapiens
gcgggaggctgggactttccattacaaatagagacttcattcctgttgag

SEQ ID NO: 5525 - DNA, 50 bp, Homo sapiens
actcaggtggtgctggtgttagtgatgctggagaagagaatattactggt

SEQ ID NO: 5526 - DNA, 50 bp, Homo sapiens
caggttgctttcgtgtccctcttctggttgctttagaagtgacgtgtaat

SEQ ID NO: 5527 - DNA, 50 bp, Homo sapiens
aaacacagcccaccccatttcagaccgccttcctgaggagaaaatgacag

SEQ ID NO: 5528 - DNA, 50 bp, Homo sapiens
gctaactggataaagtttgtgcagacattcctgagtgtacgatattgacc

SEQ ID NO: 5529 - DNA, 50 bp, Homo sapiens; identical to SEQ ID NO: 5528

SEQ ID NO: 5530 - DNA, 50 bp, Homo sapiens
agctggcttcactgctcaggtgattatcctgaaccaccaggccaaataag

SEQ ID NO: 5531 - DNA, 50 bp, Homo sapiens
agtcaggactgtctaggtcagggaagccaagatgtctgaagagagaggaa

SEQ ID NO: 5532 - DNA, 50 bp, Homo sapiens
attcaaccagtaatggtacctgaggaattgaaatgggtatttgtttctgt

SEQ ID NO: 5533 - DNA, 50 bp, Homo sapiens
agtggagaggccctgttagtttacttttcatattgagtgatgcatgaggt

SEQ ID NO: 5534 - DNA, 50 bp, Homo sapiens
gcattctatttaaaaagggagtggggagcaaatgaaaattaaatgtgggg

SEQ ID NO: 5535 - DNA, 50 bp, Homo sapiens
tcaccaggaaaacatgcttgtgaattgtgcagtaaaaggtggtaatgact

SEQ ID NO: 5536 - DNA, 50 bp, Homo sapiens
ccttttctctcccatgaccctttaacagcatctgcttcattcccctcacc

SEQ ID NO: 5537 - DNA, 50 bp, Homo sapiens; identical to SEQ ID NO: 1754

SEQ ID NO: 5538 - DNA, 50 bp, Homo sapiens
tgagtgaacaaagctgtgaaacattctgcgtttatgcaacttccttgcct

SEQ ID NO: 5539 - DNA, 50 bp, Homo sapiens
caagaagacaagcatctgtggtgcggaggcaagcaggctaactaggagtt

SEQ ID NO: 5540 - DNA, 50 bp, Homo sapiens
ttggcccagtgtgattgattgctttatctttggtacttttacttgaatgg

SEQ ID NO: 5541 - DNA, 50 bp, Homo sapiens
catccagcactaattttcatgcatttatgaaaggatgcctgaggaccctt

SEQ ID NO: 5542 - DNA, 50 bp, Homo sapiens
agcctgaggcaaataaaattccagtaatttcgaagaatgggtgttggcaa

SEQ ID NO: 5543 - DNA, 50 bp, Homo sapiens
aggaccttgacaagccgtttgagatggaatgtaggccctgatgttatgct

SEQ ID NO: 5544 - DNA, 50 bp, Homo sapiens; identical to SEQ ID NO: 5543

SEQ ID NO: 5545 - DNA, 50 bp, Homo sapiens
agtggagtgtttacaccttgctgtaacatttgaactttcacaagagatgt

SEQ ID NO: 5546 - DNA, 50 bp, Homo sapiens
atatcatattatttgatgccattaggcggcctggatcaccaattctaagt

SEQ ID NO: 5547 - DNA, 50 bp, Homo sapiens
gccaccagacagaaggaccagagtttctgattataaacaatgatgctggg

SEQ ID NO: 5548 - DNA, 50 bp, Homo sapiens
tgttggtgagcaatgtgcagaggcagagccgctgaagtatggttcctgag

SEQ ID NO: 5549 - DNA, 50 bp, Homo sapiens
ggctgctgttgactgaaattcctatcctcaaattactctagactgaagct

SEQ ID NO: 5550 - DNA, 50 bp, Homo sapiens
ctttttagtaggcaaaggttcttcttcctcctcttttggtgcagggacgc

SEQ ID NO: 5551 - DNA, 50 bp, Homo sapiens
gcgtgtatgtgggatgccataggtgtgactgtagagtcattcttccttcc

SEQ ID NO: 5552 - DNA, 50 bp, Homo sapiens
tgtaagttgactttcaaaagtctctggaaacactggactttagctggtcc

SEQ ID NO: 5553 - DNA, 50 bp, Homo sapiens
gaagcgtggcagagaactatggatcaggcagcccctctcatctttaccat

SEQ ID NO: 5554 - DNA, 50 bp, Homo sapiens
ttggtccaaactctggagccttgtgggagaacatagggcataacgtgttt

SEQ ID NO: 5555 - DNA, 50 bp, Homo sapiens
cccttcttagtaaagagacatcttctacagtaaccacagagaagaagtgg

SEQ ID NO: 5556 - DNA, 50 bp, Homo sapiens
tggacataacctgggtcagaagagaaacttttgaagctacacgaacaagc

SEQ ID NO: 5557 - DNA, 50 bp, Homo sapiens
cggctcaaataaacctttaccggatttttggggttatgcccacacccttg

SEQ ID NO: 5558 - DNA, 50 bp, Homo sapiens
ggaccactagtactccagaaccataatataactagacatgcctggaatgc

SEQ ID NO: 5559 - DNA, 50 bp, Homo sapiens
aacaagccatgtttgccctagtccaggattgcctcacttgagacttgcta

SEQ ID NO: 5560 - DNA, 50 bp, Homo sapiens; identical to SEQ ID NO: 4387

SEQ ID NO: 5561 - DNA, 50 bp, Homo sapiens
gagaaacttccgtgcatgaaggtttcctccttgactcggcagcagcggcc

SEQ ID NO: 5562 - DNA, 50 bp, Homo sapiens
ccaagtaggttttaactctggtatggtctcgtgttttcatttgttgtgca

SEQ ID NO: 5563 - DNA, 50 bp, Homo sapiens
gttcccacggagctgacttctccggggtgcctgtgccctacattaaaccc

SEQ ID NO: 5564 - DNA, 50 bp, Homo sapiens
ccgtaactccgacaaacgcagaacttcttgaggctttcttcttctaagga

SEQ ID NO: 5565 - DNA, 50 bp, Homo sapiens
tctggaccctgcttgggttcacagcattggtggaggtaagtagtattctc

SEQ ID NO: 5566 - DNA, 50 bp, Homo sapiens
gaagaggaagctcatccgaagtcttccgacagagtgagccgtcatgcccg

SEQ ID NO: 5567 - DNA, 50 bp, Homo sapiens
agtgtgtattcttgatgtttattggctcatgtggacagaaatgtacaggg

SEQ ID NO: 5568 - DNA, 50 bp, Homo sapiens
agatgaggctgctctgaagattcagtaattaggatggacagtcagctact

SEQ ID NO: 5569 - DNA, 50 bp, Homo sapiens
tgggctttggggttcagtttgttacctttggagacttatttaatgaaacc

SEQ ID NO: 5570 - DNA, 50 bp, Homo sapiens
cagtggttcctgagagaatcttagttcaaaggactgcccccgccaacccc

SEQ ID NO: 5571 - DNA, 50 bp, Homo sapiens
accgccaaagccaatcatccactttcagtacttacctaaccaatctccca

SEQ ID NO: 5572 - DNA, 50 bp, Homo sapiens
caggatgttattgacagggtggcctttgtgattcctccggtggtggcagc

SEQ ID NO: 5573 - DNA, 50 bp, Homo sapiens
gccatttcatttgctgtgtggttagacttccaggaggctgtttagctcta

SEQ ID NO: 5574 - DNA, 50 bp, Homo sapiens
cctttgtgaaaagtcacctgtgactgtcaggggtatgctatgggcctttt

SEQ ID NO: 5575 - DNA, 50 bp, Homo sapiens
gatccactttggggttcggcggcagattattccgctggtagagccggatg

SEQ ID NO: 5576 - DNA, 50 bp, Homo sapiens
aataagggactcattcattatgcagcaaatgttgtttgttattggcttgc

SEQ ID NO: 5577 - DNA, 50 bp, Homo sapiens
cttcatggtctccagccaggactccatcagcgccacggcttcatccgaac

SEQ ID NO: 5578 - DNA, 50 bp, Homo sapiens
ttgatgctcatcatctgctcgaggtgattgatgccaggttgacgcaccat

SEQ ID NO: 5579 - DNA, 50 bp, Homo sapiens
tcctttggataaggtccaaaacctgtaacacatgaccctcagagcccttt

SEQ ID NO: 5580 - DNA, 50 bp, Homo sapiens
cccggcgacttcaccacccgctatctgggcaccaaagactatatctagat

SEQ ID NO: 5581 - DNA, 50 bp, Homo sapiens
cgcaatagtcctcgacaagtcgccaaccctcccacttcggtcgatcagct

SEQ ID NO: 5582 - DNA, 50 bp, Homo sapiens
cgtcgggtacctcgccgataaaatcgctgatggcctggtcgatcctgaag

SEQ ID NO: 5583 - DNA, 50 bp, Homo sapiens
atcttatccctctgttactcaatgtgagtgcatactttacattgcctact

SEQ ID NO: 5584 - DNA, 50 bp, Homo sapiens
ggtccttgaagatgacgcggatgatcgaggtctctgcgccgtaggcgatg

SEQ ID NO: 5585 - DNA, 50 bp, Homo sapiens
atgatgaagctgctgtccaacgccttcgtctgccagtttctgctggtgtg

SEQ ID NO: 5586 - DNA, 50 bp, Homo sapiens
tccttgccagagccttcgggttctacgatttgatcgacgacgctggtgtc

SEQ ID NO: 5587 - DNA, 50 bp, Homo sapiens
tcgaacatgggcagctccgtttcaagatggctcaagactagcggattggg

SEQ ID NO: 5588 - DNA, 50 bp, Homo sapiens
agtgatagagaccaaagactgctttttaattttgtgggggagggggtgga

SEQ ID NO: 5589 - DNA, 50 bp, Homo sapiens
cgggtcactcatgttggctactaacccttttcgtgcgccgggcattctag

SEQ ID NO: 5590 - DNA, 50 bp, Homo sapiens
cttgtccttgatcgcttccttctctgcaagggagagcttctggaccttca

SEQ ID NO: 5591 - DNA, 50 bp, Homo sapiens
cttgtttgacatcagcgccatctcgacagcgtattccgctatgactgttt

SEQ ID NO: 5592 - DNA, 50 bp, Homo sapiens
cacgaagccttcgatcagttgcagcacgcggccagagcggtcgatagaac

SEQ ID NO: 5593 - DNA, 50 bp, Homo sapiens
cattttgccatctgcgagcatctgggtattgacatgatccccagtggagc

SEQ ID NO: 5594 - DNA, 50 bp, Homo sapiens
caccaagctggtcaacatccaggcgaatggctattacgtggatgagatca

SEQ ID NO: 5595 - DNA, 50 bp, Homo sapiens
ttgctgatacggcctttgatcatgttttcaacgatgttttccggcttgcc

SEQ ID NO: 5596 - DNA, 51 bp, Homo sapiens
cctcgacaaactaaatgttgatttgaattggcctgttatcatcttgatcac

SEQ ID NO: 5597 - DNA, 50 bp, Homo sapiens
gtttcagatcgggccgctcccgccgggtacctatagcggaatcgaatttc

SEQ ID NO: 5598 - DNA, 50 bp, Homo sapiens
gaaaacagaaatgatgctcggcacattctcgtccagcacctcggcaacgg

SEQ ID NO: 5599 - DNA, 50 bp, Homo sapiens
aactgtattcgatcaccgtggcgctgatggtgtcagcagtcgccttgttc

SEQ ID NO: 5600 - DNA, 51 bp, Homo sapiens
agttgacatataacccactttacatacattccaaaattgcgagtagtgagt

SEQ ID NO: 5601 - DNA, 50 bp, Homo sapiens
atatcgtaccgagaaactagtgcggatatctgaccaggtatggcggttgg

SEQ ID NO: 5602 - DNA, 50 bp, Homo sapiens
gtggatgacctgatccaggtcggcctgatcggcctgactgatgagctgtc

SEQ ID NO: 5603 - DNA, 50 bp, Homo sapiens
atgatgaccagatgctctggcaccgtgtcgagttcgaggatgccgacatt

SEQ ID NO: 5604 - DNA, 50 bp, Homo sapiens
gatctgggacgcatggccgaagctgaaaagctggctgtagaagacctcga

SEQ ID NO: 5605 - DNA, 50 bp, Homo sapiens
aacatggcaatatttattggtcctaatactgtcactggcaaggttggtgt

SEQ ID NO: 5606 - DNA, 50 bp, Homo sapiens
gaggcagaggtgtagcgagtccaggctctcttcgaacgttgcacccgacg

SEQ ID NO: 5607 - DNA, 50 bp, Homo sapiens
gtcccacacgttcggccctgactctgctgtgttcgacgaggacaatctcg

SEQ ID NO: 5608 - DNA, 50 bp, Homo sapiens
catgacgttgtgctcgacaccccaacagatcacgtaatcagcctggtgga

SEQ ID NO: 5609 - DNA, 51 bp, Homo sapiens
taggctatagagatgtgagggattattattagtcacacctctagtcatgcc

SEQ ID NO: 5610 - DNA, 50 bp, Homo sapiens
ggctgccggatgtgtaggtcttcccatgttgtgaagtaacggtgctccac

SEQ ID NO: 5611 - DNA, 50 bp, Homo sapiens
tgccctgtatagtgttgtaaaaattagaatgtttcacccaaaccatctgg

SEQ ID NO: 5612 - DNA, 50 bp, Homo sapiens
gtctttcgaatcgctctttagctcgtgcgggctgttgtcccacttgttgg

SEQ ID NO: 5613 - DNA, 50 bp, Homo sapiens
ctatgcgctgcgctacaagctggacctgtattcggacttcagctactacc

SEQ ID NO: 5614 - DNA, 50 bp, Homo sapiens
ttcgaagcgacgctgcgtgcgctgctcgtccaattgcagcatggataagg

SEQ ID NO: 5615 - DNA, 50 bp, Homo sapiens
ccttccgctgtcccttcagtagctgtttctgttccctgacgcccacttct

SEQ ID NO: 5616 - DNA, 50 bp, Homo sapiens
caatgcagcggctgatgcagatcacccacgagatgcaggacgaaggcgag

SEQ ID NO: 5617 - DNA, 50 bp, Homo sapiens
tcattcagtctgagtaggaggaaagaggacaggttgttggagagttggtt

SEQ ID NO: 5618 - DNA, 50 bp, Homo sapiens
taattgccgctgaagcacgaatcctcgaaatgcgtcaccttcggattgac

SEQ ID NO: 5619 - DNA, 50 bp, Homo sapiens
aaatgtggtgacaaagtaccagcaagaactggactgtgtttctggagcct

SEQ ID NO: 5620 - DNA, 50 bp, Homo sapiens
gttcatcgtctcgcgtcgcaagaagtaagggctaggccatgactcgttcg

SEQ ID NO: 5621 - DNA, 50 bp, Homo sapiens
ctcttggcagccctgctctcgtgggtcagcatcgtcgcgtgctccggtgg

SEQ ID NO: 5622 - DNA, 50 bp, Homo sapiens
gtgctcgctgagctggtccagaaatccgtcgactgaggcgatggcggctg

SEQ ID NO: 5623 - DNA, 50 bp, Homo sapiens
catgaacaagggccggatcatcctgatgcccaacacactggacttcggtg

SEQ ID NO: 5624 - DNA, 50 bp, Homo sapiens
cacccgttgtaggcgacgagcgtgaacgaaaacgtgtcggacggcttgta

SEQ ID NO: 5625 - DNA, 50 bp, Homo sapiens
catatgcggctgtgccatagccggatgttcttcgtgcgtgcctacccccg

SEQ ID NO: 5626 - DNA, 50 bp, Homo sapiens
ttctttccgtcgcgcatcggaatgcgaaactcgtacttcgtgtagaactc

SEQ ID NO: 5627 - DNA, 50 bp, Homo sapiens
gccaggggctttatcacttccatggccgcagcgatgaccaggtcaagctg

SEQ ID NO: 5628 - DNA, 50 bp, Homo sapiens
cgccgaccaagcttaccgacttctcgccgatctactgcgacgaagaaggc

SEQ ID NO: 5629 - DNA, 50 bp, Homo sapiens
ggtagtgacgtgctgaatgacggtgccgtccatcatcgggtcggagtaag

SEQ ID NO: 5630 - DNA, 50 bp, Homo sapiens
ttcaggactcgtttcacgtaggcaacgctgtctaaagttcccaagggatt

SEQ ID NO: 5631 - DNA, 50 bp, Homo sapiens
ctctttacccggaaacaggttggggagatgacacgcagaaaatcatacgc

SEQ ID NO: 5632 - DNA, 50 bp, Homo sapiens
ctttggatatatcgagaaaggccagggcctgaacaaggaaagcttccagg

SEQ ID NO: 5633 - DNA, 50 bp, Homo sapiens
aaggctggtcaagaatcttgagacggaattgcacagtctcggcgtgatcc

SEQ ID NO: 5634 - DNA, 50 bp, Homo sapiens
gatcgattcgggggtgacatcggcgctgagcaccatcaccggaacataag

SEQ ID NO: 5635 - DNA, 50 bp, Homo sapiens
ctgagatcaccctgaacaccgacaaggacgagatcgcagtctgcaacctg

SEQ ID NO: 5636 - DNA, 50 bp, Homo sapiens
ctgaaggctttggcgacaaccaggtctatccgtttgaaattggcgagaac

SEQ ID NO: 5637 - DNA, 50 bp, Homo sapiens
tcttgtgccagcacgtcttgctgatagccgatgaatcgcgtccctttgtc

SEQ ID NO: 5638 - DNA, 50 bp, Homo sapiens
gaactcctcaaggaaatagtccaccgcctgctgcttggacgctgccagtt

SEQ ID NO: 5639 - DNA, 50 bp, Homo sapiens
gtgacctcggggtcccccttggtgagggtgccggtcttgtcgaagacgac

SEQ ID NO: 5640 - DNA, 50 bp, Homo sapiens
gtgttcgggcttcatgtcgccaacaccatcggcactggcatcatcgatcc

SEQ ID NO: 5641 - DNA, 50 bp, Homo sapiens
aggttgatttccacttcctcgggaggtttcgccacctcttcgcctttgag

SEQ ID NO: 5642 - DNA, 50 bp, Homo sapiens
gttagcttccacgctttatctcctgctctgagtgtgtacccgcgctgctc

SEQ ID NO: 5643 - DNA, 50 bp, Homo sapiens
ttaaagtggtaagggaggtttctactcctggggaaacattaaagtacctt

SEQ ID NO: 5644 - DNA, 50 bp, Homo sapiens
ctttctccgacttcgagatctgcccgtggtcgagatcgtggtagatgatg

SEQ ID NO: 5645 - DNA, 50 bp, Homo sapiens
aactggatagagcacgagccttctaagcttggagttgcaggttcgaatcc

SEQ ID NO: 5646 - DNA, 50 bp, Homo sapiens
gaagatcggcgcaacgaagaccgcttccacttcatcaactggaccaagaa

SEQ ID NO: 5647 - DNA, 50 bp, Homo sapiens
tgcttctgtgacagattagcttacatcttaccacctcaccgagaagagct

SEQ ID NO: 5648 - DNA, 50 bp, Homo sapiens
agctcaagagcttccgcgacgtacccagcaaagtaacgctcgacgaatgc

SEQ ID NO: 5649 - DNA, 50 bp, Homo sapiens
atcgaagacgtgatgctgaacctttgggcgaaggccgagaaggaaggcaa

SEQ ID NO: 5650 - DNA, 50 bp, Homo sapiens
cgataccctcactagacctcggatcgaaataaatcagagcgatcacatcg

SEQ ID NO: 5651 - DNA, 50 bp, Homo sapiens
ggggatacacaccccacaagccttcctgcggcttcatcacggttaccacc

SEQ ID NO: 5652 - DNA, 50 bp, Homo sapiens
gatcttggtgagaagctcggtcatgtagaagacctcgccctgggacacta

SEQ ID NO: 5653 - DNA, 50 bp, Homo sapiens
attttatcgccagctacgtcggcattggtcaggacgacctgaaggggaat

SEQ ID NO: 5654 - DNA, 50 bp, Homo sapiens
tgatgcggagagcgaggtagatcccggcggagttttcgtcgatgggaaag

SEQ ID NO: 5655 - DNA, 50 bp, Homo sapiens
gtacacttcctggatctgatccacgaggtaacgagcgagagtggtgatac

SEQ ID NO: 5656 - DNA, 50 bp, Homo sapiens
gtgacttcatgctcggggttgagcttggcgtccaccaccttttcccactc

SEQ ID NO: 5657 - DNA, 50 bp, Homo sapiens
ccggtgtccttgatcagcttcagcagtggcttgacgtagatgcgggtcgg

SEQ ID NO: 5658 - DNA, 50 bp, Homo sapiens
catcagtgtttctcctgctgggactgttgcatgtggtgcatcacggtttg

SEQ ID NO: 5659 - DNA, 50 bp, Homo sapiens
gcgaggcgaaacatagcttccattgtgtcttttctccttatgcgtcttgc

SEQ ID NO: 5660 - DNA, 50 bp, Homo sapiens
aatgagacccgccgtccctggagatgaagatgtcgtccgactccgtccac

SEQ ID NO: 5661 - DNA, 50 bp, Homo sapiens
cggatgttgtcgttccagaacgaaggatcggcctcttgggcctggatttc

SEQ ID NO: 5662 - DNA, 50 bp, Homo sapiens
ggcaccgacttgggcctgagagaggcgcaggtcatcaatatagaatcggg

SEQ ID NO: 5663 - DNA, 50 bp, Homo sapiens
ccatgctgaacttggccaggtccttgacggcggtgttttccgacagcacc

SEQ ID NO: 5664 - DNA, 50 bp, Homo sapiens
cgcgatgatctcgtccttcggcatggcgatgcgctattccttcgacatgg

SEQ ID NO: 5665 - DNA, 50 bp, Homo sapiens
gcccattgaccgtatcgcgtcatcttgctggcatttctaagaaaataccg

SEQ ID NO: 5666 - DNA, 50 bp, Homo sapiens
tgaaacagggaaaagccaggaagatctccggttccacgtccaatttgtac

SEQ ID NO: 5667 - DNA, 50 bp, Homo sapiens
caagaatgacggaaaaatccgtgagcacaaggcaaaggcttgccgtgtgg

SEQ ID NO: 5668 - DNA, 50 bp, Homo sapiens
gacttgatcacaacccgatccgtaacgacgtattggagccactcgaacaa

SEQ ID NO: 5669 - DNA, 50 bp, Homo sapiens
cttctcgccgtaacttttccgccgagcacgctacgcacgtaggtgttgtg

SEQ ID NO: 5670 - DNA, 50 bp, Homo sapiens
tcgactacgacttcaacttccccaaacggtgggagaagcgagcttgaggc

SEQ ID NO: 5671 - DNA, 50 bp, Homo sapiens
aagttgatcagatcacgggccacgcctgcaaccagaggcttgtcatcgtc

SEQ ID NO: 5672 - DNA, 50 bp, Homo sapiens
tgatctgattgtgaggagagtggagaaggtggtatagaagctgaaagggt

SEQ ID NO: 5673 - DNA, 50 bp, Homo sapiens
cttcatgctcgagaagaaaatgctccgtgcctccgacgacgccaccatcg

SEQ ID NO: 5674 - DNA, 50 bp, Homo sapiens
cagatggtcacgagacgcttgtccgtgatgtcttccgtcagcgtgcagag

SEQ ID NO: 5675 - DNA, 50 bp, Homo sapiens
tgatggatttggaaagtgttattctgtttgacttctccctgctctgctca

SEQ ID NO: 5676 - DNA, 50 bp, Homo sapiens
ttgaacgggtatagccaccaaggcattggctgcaaagtcgggcaaaactt

SEQ ID NO: 5677 - DNA, 50 bp, Homo sapiens
actgtgtattgatgagtatctgatgcctataacatctgtaggaggctaca

SEQ ID NO: 5678 - DNA, 50 bp, Homo sapiens
gtacgaaggtggcgatgatgcgttcgatcacctcggggatttcctcggcg

SEQ ID NO: 5679 - DNA, 50 bp, Homo sapiens
cgaccttcggcgtttccgcttcggaacccgtgaaggcgttcttcactttg

SEQ ID NO: 5680 - DNA, 50 bp, Homo sapiens
attcgctggcaacataattaccagactcacatcgaacgaagctcggttcc

SEQ ID NO: 5681 - DNA, 50 bp, Homo sapiens
tgttcgttgccatccttgtcgaggaacatctcgctttccagttccgcctg

SEQ ID NO: 5682 - DNA, 50 bp, Homo sapiens
tttgggggatccttttgtaatgacttacactggaaatgcgaacatttgca

SEQ ID NO: 5683 - DNA, 50 bp, Homo sapiens
ggacaaggggcacccggattatatttcccaccaatcctaatcctaaaccc

SEQ ID NO: 5684 - DNA, 50 bp, Homo sapiens
tggagcttattttggagaactgtcaccattttatcccagttggcaatttt

SEQ ID NO: 5685 - DNA, 50 bp, Homo sapiens
attatgggtaaggcttgggcttgttcccacatgttaaccaaatggcctca

SEQ ID NO: 5686 - DNA, 50 bp, Homo sapiens
gggagggccaaagaaatctttttcccgtttcaaattatgttccccaaaaa

SEQ ID NO: 5687 - DNA, 50 bp, Homo sapiens
ttaccccaatgcttttgccccggtggcccagtttgtaaattggtttgatt

SEQ ID NO: 5688 - DNA, 50 bp, Homo sapiens
ccccccttggcaggttaattggtgtttaaggaaccctccagggtgggggg

SEQ ID NO: 5689 - DNA, 51 bp, Homo sapiens
ccccccagttttaatgttagggggaagggatttaaccccttatttaaaaaa

SEQ ID NO: 5690 - DNA, 50 bp, Homo sapiens
ctatcacccttgatatgaaattccagaattttctgtgataccacatggcc

SEQ ID NO: 5691 - DNA, 50 bp, Homo sapiens
actccgggccttaatggatttggcctgtcctcaagaatggtaattatgaa

SEQ ID NO: 5692 - DNA, 50 bp, Homo sapiens
acgtggtttcagtccttagcaccgtggtattgacatgacatcagttgcaa

SEQ ID NO: 5693 - DNA, 50 bp, Homo sapiens
cacaacttgctgttcacgtctttggggtgttttccattcctaatagatgg

SEQ ID NO: 5694 - DNA, 50 bp, Homo sapiens
aaacccgtcctccattataattacctttcaaagggcaagtcaaaagttgt

SEQ ID NO: 5695 - DNA, 50 bp, Homo sapiens
aaacagcacaacatgagtgtttcctaccacatcaattttaatgaagacac

SEQ ID NO: 5696 - DNA, 50 bp, Homo sapiens
cggaatcgggtttccattggaccccaaaaatttccctttgggcttcatga

SEQ ID NO: 5697 - DNA, 50 bp, Homo sapiens
tgaggatagaagcagccttttatatttttgtgtggtaaagcaaattggca

SEQ ID NO: 5698 - DNA, 50 bp, Homo sapiens
ggggcaaatttcaagggacctccccaaagggggtgttttccctggatggg

SEQ ID NO: 5699 - DNA, 51 bp, Homo sapiens
aaacaggaagggggtttgggccctttgatcaactggaacctttggatcaag

SEQ ID NO: 5700 - DNA, 50 bp, Homo sapiens
actctttgtctttttaagacccctaatagccctttgtaacttgatggctt

SEQ ID NO: 5701 - DNA, 50 bp, Homo sapiens
ccggctgcctccatcccagaagagtgcgcagagaattaaatctagatatt

SEQ ID NO: 5702 - DNA, 50 bp, Homo sapiens
gggatgtaatacatatttttccaaataaaatgcctcatgggctttggggc

SEQ ID NO: 5703 - DNA, 50 bp, Homo sapiens; identical to SEQ ID NO: 4309

SEQ ID NO: 5704 - DNA, 50 bp, Homo sapiens
agttagtatacagccagaacagccaagcctcaattcttgtaccttgtgtc

SEQ ID NO: 5705 - DNA, 50 bp, Homo sapiens
ccctgatcctctgtagggaacttccttttctctaatcctagatcttttca

SEQ ID NO: 5706 - DNA, 50 bp, Homo sapiens
gaggcatcagaggttcaggagagttacaggcagcaggtgcggtataatat

SEQ ID NO: 5707 - DNA, 50 bp, Homo sapiens
tttgtttctttgggcctgatttgtatctctggaaggcattaattcttgaa

SEQ ID NO: 5708 - DNA, 50 bp, Homo sapiens
gctttgcctctcggaggagtcaaaggggcagtaactgtatggggtgagag

SEQ ID NO: 5709 - DNA, 50 bp, Homo sapiens
gctcccgaatattgtaatttgttgccccctatgtacccaaccccctgaaa

SEQ ID NO: 5710 - DNA, 50 bp, Homo sapiens
aggaagtatgagagttctgaaacccttgatagaaactggaagcctgccat

SEQ ID NO: 5711 - DNA, 50 bp, Homo sapiens
gacatagggttgcagtagtgagtgggcatctgttctcagaaggcagtgcc

SEQ ID NO: 5712 - DNA, 50 bp, Homo sapiens
ttctggccttgttcacctagaaacgctatttcctgtgttatggttctggc

SEQ ID NO: 5713 - DNA, 50 bp, Homo sapiens
gctctgggaaagagacagggaagtctggaatggaaaagaacacgatgaga

SEQ ID NO: 5714 - DNA, 50 bp, Homo sapiens
gggttacatttgagtctctgtacctgcttggaagaaataaaaatacgtgt

SEQ ID NO: 5715 - DNA, 50 bp, Homo sapiens
ctgggaatatgaagcgaacgccacacactagaacgcgccctgggagctgg

SEQ ID NO: 5716 - DNA, 50 bp, Homo sapiens
gctgcttttgcccatccaggtttccacatcctaatctttgcttttcttgt

SEQ ID NO: 5717 - DNA, 50 bp, Homo sapiens
tgtaaatgtggtttgactatttctgtatgtccccatctattgatgagggt

SEQ ID NO: 5718 - DNA, 51 bp, Homo sapiens; identical to SEQ ID NO: 5427

SEQ ID NO: 5719 - DNA, 50 bp, Homo sapiens
acataaactgtccctttaggaagaagcccaatgcccgattttgcccttta

SEQ ID NO: 5720 - DNA, 50 bp, Homo sapiens
ggacaagtggcatcggtactatatttcccaccaatcctaatcctaatccc

SEQ ID NO: 5721 - DNA, 50 bp, Homo sapiens
tatgtccctttttctcctcccttccccattccctggcatcatattgggac

SEQ ID NO: 5722 - DNA, 50 bp, Homo sapiens; identical to SEQ ID NO: 4876

SEQ ID NO: 5723 - DNA, 50 bp, Homo sapiens
tgtgggcttggtataaaccctactttgtgatttgctaaagcacaggatgt

SEQ ID NO: 5724 - DNA, 50 bp, Homo sapiens
ccgcctgaaacgggcattttgtaaatggggtttgactatttttgtatgtc

SEQ ID NO: 5725 - DNA, 50 bp, Homo sapiens
actggcaaatgaagcatactggcttgcagggaccttctgattcaagtaca

SEQ ID NO: 5726 - DNA, 50 bp, Homo sapiens
gaattcgatttgagatctgagggcagacccgaaccaggaaagcaactcag

SEQ ID NO: 5727 - DNA, 50 bp, Homo sapiens
aatgcaccaggctgccacctgcaccagtggttgctacatgggataagaaa

SEQ ID NO: 5728 - DNA, 50 bp, Homo sapiens
tatgataggattctccacagtggcttccgactcaggctccaatggaccaa

SEQ ID NO: 5729 - DNA, 50 bp, Homo sapiens
tgctgtatgggcaggttgtcttattatgtgatcaacagatgtccaggaac

SEQ ID NO: 5730 - DNA, 50 bp, Homo sapiens
acctccaagaacatctgcctttgttgaacgtgtttattacctgtccactc

SEQ ID NO: 5731 - DNA, 50 bp, Homo sapiens
ccttttgccccttagcccttggataatccggctgggaatgggggtgaggg

SEQ ID NO: 5732 - DNA, 50 bp, Homo sapiens
cccaaataagctctgtacttcggttacctatgtacctgttaccactttca

SEQ ID NO: 5733 - DNA, 50 bp, Homo sapiens
gccacatgtcctattctcacacaggtgctttaatttcagcccagtctcta

SEQ ID NO: 5734 - DNA, 50 bp, Homo sapiens
cttgaaggggctttgttgggtttttggggttttgggtgggactcccaaag

SEQ ID NO: 5735 - DNA, 52 bp, Homo sapiens
ggggttttaaaaattttcccgatttcaaaattaattttccgttgccccccgg

SEQ ID NO: 5736 - DNA, 50 bp, Homo sapiens
ccccctggggtttttgggaatgaggtaaggctttgaatttggtttgatat

SEQ ID NO: 5737 - DNA, 50 bp, Homo sapiens
acatgcttagagctggaggcttgaaaccataatcccaattaagtgctgtc

SEQ ID NO: 5738 - DNA, 50 bp, Homo sapiens
tgtttgtccaggaaaaggaagagggggaaattaaaacctttccggttagt

SEQ ID NO: 5739 - DNA, 50 bp, Homo sapiens
gcactgctccgtctagctgtatgacctttgttatgtttcttttcttccgt

SEQ ID NO: 5740 - DNA, 50 bp, Homo sapiens
cttcaatctgggctgggcactccacgcacataatcgtcactctcggagga

SEQ ID NO: 5741 - DNA, 50 bp, Homo sapiens
gcgggaagtgaaagcggaggctgggacaaggggaacttactgctcaaaaa

SEQ ID NO: 5742 - DNA, 50 bp, Homo sapiens
agtggtgtggtggcaataggaaaagaaaagatcaggatgagaaattgctt

SEQ ID NO: 5743 - DNA, 50 bp, Homo sapiens
ccaagggccttttggggttgtttcctataacttcagtattgtaaattagt

SEQ ID NO: 5744 - DNA, 50 bp, Homo sapiens
cataaaggggcattgccctagccggtccggcctttttccagtccatcctg

SEQ ID NO: 5745 - DNA, 51 bp, Homo sapiens
aggtttaagaaatttcccctaaatcttgtttggttggttgggatgaaaagt

SEQ ID NO: 5746 - DNA, 50 bp, Homo sapiens
aattgatcccattcttgctgaagtagacagtgccctcaagtggaattaaa

SEQ ID NO: 5747 - DNA, 50 bp, Homo sapiens
ctccaatgctgttatcccggctgggtcctcacactcccccaacaatccca

SEQ ID NO: 5748 - DNA, 50 bp, Homo sapiens
agaatgcgctatttccctcaaagccctggctgtaataaagaagccgattt

SEQ ID NO: 5749 - DNA, 50 bp, Homo sapiens
ctgaggtcagtgtggtttggtggaaggattatgatatttacaagctgagt

SEQ ID NO: 5750 - DNA, 50 bp, Homo sapiens
ggtcaatgttttgaaatttgtggagcaaaccccagttttatgcccttggt

SEQ ID NO: 5751 - DNA, 50 bp, Homo sapiens
agttggaaaatttagaaatgtccactgtaggacgtggaatatggcgtcga

SEQ ID NO: 5752 - DNA, 50 bp, Homo sapiens
ttcacgtcctaaagtgtggtagacgcgcccgcgaatttagtagtagtagg

SEQ ID NO: 5753 - DNA, 50 bp, Homo sapiens
ggacaagtggcatccgtattatatttcccaccattcctattcttaatccc

SEQ ID NO: 5754 - DNA, 50 bp, Homo sapiens
ggtctgcctcagtcttctactcatcagcaccacactgtcaaaatgttgga

SEQ ID NO: 5755 - DNA, 50 bp, Homo sapiens
agatgaattgaagcaaaaagttttcagtaccagcagcaaggcagaccccc

SEQ ID NO: 5756 - DNA, 50 bp, Homo sapiens
tcacctccacctctgagggagcaacgaatacaaaggtagacccccaaaag

SEQ ID NO: 5757 - DNA, 50 bp, Homo sapiens
ccccagccagcacttcccttttctgcgagggttttctgtttctttgatta

SEQ ID NO: 5758 - DNA, 50 bp, Homo sapiens
agaaaatttgaaccctacgcttctcccatcccacttcttactccatcccg

SEQ ID NO: 5759 - DNA, 50 bp, Homo sapiens
ctgtggcatcattcacaccaccagcagagtcccttccaagaggggtctgg

SEQ ID NO: 5760 - DNA, 50 bp, Homo sapiens
ccgtgttaaaaccaaagtttgggatttttcgggtattcattggaagtcac

SEQ ID NO: 5761 - DNA, 50 bp, Homo sapiens
cgagagcctggaagctttgcacactactgcctggaagatctgattctttg

SEQ ID NO: 5762 - DNA, 50 bp, Homo sapiens
tgttttaaaagtgggtttatttcaaccccttcactcccggttggtgaccg

SEQ ID NO: 5763 - DNA, 50 bp, Homo sapiens
tcttctctcagtcttcagcaagtagcttctttcagaactgcctcctcccg

SEQ ID NO: 5764 - DNA, 50 bp, Homo sapiens
gttttctgcatcccaaatgtcctggggcatgtgtcccttccttgctgacc

SEQ ID NO: 5765 - DNA, 50 bp, Homo sapiens
tgttatgattctctcaatttcataaagctcttctggcagaggagacagat

SEQ ID NO: 5766 - DNA, 50 bp, Homo sapiens
aaatggattacaatttccctgacatttgggcataaaacatctgccatcct

SEQ ID NO: 5767 - DNA, 50 bp, Homo sapiens
tcctccttccagagacctttgctttactgccattttttctgtgggctttt

SEQ ID NO: 5768 - DNA, 50 bp, Homo sapiens
aggcatagcagtagaatctgtcaaaaaggaggcatggaatgaaatgaacc

SEQ ID NO: 5769 - DNA, 50 bp, Homo sapiens
ctgaccctctcgcccctccacctgtgcttctgccctaggataacgctggg

SEQ ID NO: 5770 - DNA, 50 bp, Homo sapiens
gacccaaagaaaagatcaagaccgcatgtagcaaatgtagcaaggaggca

SEQ ID NO: 5771 - DNA, 50 bp, Homo sapiens
ctaatttcccactaaaaggtccagaaaaattgatgccacctgtagtttgg

SEQ ID NO: 5772 - DNA, 50 bp, Homo sapiens
gtaaagttccaagcgagtggaaggtaaatcacgactgtggcaccggagcc

SEQ ID NO: 5773 - DNA, 50 bp, Homo sapiens
gaaactgaatgaccatggaatgctgaaattccaaaagaaaaacgtcgcgc

SEQ ID NO: 5774 - DNA, 50 bp, Homo sapiens
tctctcaggtcgtcttcagagtccattccctttgtcttgatcttttctct

SEQ ID NO: 5775 - DNA, 50 bp, Homo sapiens
ctcccatcattccctcccgaaagccattttgttcagttgctcatccacgc

SEQ ID NO: 5776 - DNA, 50 bp, Homo sapiens
gccctgccccctacccttgccctttaaatttttgggactgaataaagaat

SEQ ID NO: 5777 - DNA, 50 bp, Homo sapiens
tgcaggataacttgctcatgaaaggaaatgccagattaaaccccttgcca

SEQ ID NO: 5778 - DNA, 50 bp, Homo sapiens
gccttcccttcgttcctttccaggcaataatgacatcattagtgatgcaa

SEQ ID NO: 5779 - DNA, 50 bp, Homo sapiens
cgccacggctccaatccctatatgagtgagcagtagaatcacataggaat

SEQ ID NO: 5780 - DNA, 50 bp, Homo sapiens
cctagaatcagactttaagcacaagcagggagggaaagcacttgagcagt

SEQ ID NO: 5781 - DNA, 50 bp, Homo sapiens
gcacatgcaaaaactcagatgtgcaaataactgttccctattaactacaa

SEQ ID NO: 5782 - DNA, 50 bp, Homo sapiens
ggtgctcaaactgtattttctccctccctccctccttctttctttccaga

SEQ ID NO: 5783 - DNA, 50 bp, Homo sapiens
ttcttccacgggatttctaattcattaaataggacctccacaccagacct

SEQ ID NO: 5784 - DNA, 50 bp, Homo sapiens
tatccagcctgacttcttcatgctgtactagccttccaatccttaactaa

SEQ ID NO: 5785 - DNA, 50 bp, Homo sapiens
tggacattgggggtcaaacccttttgtttaaattttccctttcccagggc

SEQ ID NO: 5786 - DNA, 50 bp, Homo sapiens
gctgtgccacggtcaggtggcttccaatctgtactcaattgttactgtac

SEQ ID NO: 5787 - DNA, 50 bp, Homo sapiens
tcagagatgctgatgtcatataagtagtttccctgtctggccttggatgt

SEQ ID NO: 5788 - DNA, 50 bp, Homo sapiens
gtatgactgatgatagctgcgaatgaggaggagggaagggaaggctggag

SEQ ID NO: 5789 - DNA, 50 bp, Homo sapiens
ccattgccccggtgttttggtttaattttcccaggcttattttaaaggcc

SEQ ID NO: 5790 - DNA, 50 bp, Homo sapiens
aggaaattaaacatgagcatgacatgaccccaactctcaagaaatcccca

SEQ ID NO: 5791 - DNA, 50 bp, Homo sapiens
atcaggtcccctacaaaattagctactttggcctttcctacaaaattagc

SEQ ID NO: 5792 - DNA, 50 bp, Homo sapiens
tcattcgtttgctttctctgactgacaggcagtaatgacttcaataagct

SEQ ID NO: 5793 - DNA, 50 bp, Homo sapiens
agggcctgcttcagagtttgtttcctaaataaaacaatggctctccccgt

SEQ ID NO: 5794 - DNA, 50 bp, Homo sapiens
cccccaacttacatggaaaagggatggttgcatttctgtgtcatatgcat

SEQ ID NO: 5795 - DNA, 50 bp, Homo sapiens
gcagagggaagaggaaatgctttgaagccttgctagttatttaattagtt

SEQ ID NO: 5796 - DNA, 50 bp, Homo sapiens
gacatagttgcaaaacacaatacttaatactttttctggaggagggggcc

SEQ ID NO: 5797 - DNA, 50 bp, Homo sapiens
accccttttcttaatttctcaggaaaatggcagctccttcttttgtcgtc

SEQ ID NO: 5798 - DNA, 50 bp, Homo sapiens
cctccggtgtcttcggaagcactgaagggacatctggggaccctcacctg

SEQ ID NO: 5799 - DNA, 50 bp, Homo sapiens
actctttgaccaataaatcactggaatagaggttccagcatattctgaga

SEQ ID NO: 5800 - DNA, 50 bp, Homo sapiens
atgcttacaccctggatgaataaagtctttatttacacctccacctcccc

SEQ ID NO: 5801 - DNA, 50 bp, Homo sapiens
ctcttcacaggtcataagcccctctgagcggcgacagtcctcgcatccag

SEQ ID NO: 5802 - DNA, 50 bp, Homo sapiens
cagctcgacctcagtccccttcagaaataagatggcggctgcgctgacag

SEQ ID NO: 5803 - DNA, 50 bp, Homo sapiens
tttcaacgtgtacctttcctgggaaaccatctcaataaacacattttggt

SEQ ID NO: 5804 - DNA, 50 bp, Homo sapiens
gctggacacatgggttaagaggaggaaaagtaggaaaggaggaggggaaa

SEQ ID NO: 5805 - DNA, 50 bp, Homo sapiens
ggctgggaccagggtttttcaagccaccttttcctgtctcagttcagaga

SEQ ID NO: 5806 - DNA, 50 bp, Homo sapiens
cccactttcacacatgactcacacgactgaaggaaagaaagggcatcctt

SEQ ID NO: 5807 - DNA, 50 bp, Homo sapiens
aagaaattaaggaaggcaagagggtaggtgttggcccatggaagtttccc

SEQ ID NO: 5808 - DNA, 50 bp, Homo sapiens
ctggcaaatattgcggaagatgtactgaaatgtaattgaaatgtagctgc

SEQ ID NO: 5809 - DNA, 50 bp, Homo sapiens
agcataagagatacgaagctgatggtaattaacttgtaccccttgaagtg

SEQ ID NO: 5810 - DNA, 50 bp, Homo sapiens
agtgtcagacaattagatactctttcctgtcttcaggagcccatctggaa

SEQ ID NO: 5811 - DNA, 50 bp, Homo sapiens
gaagtgtaaacatgccaacagggtttatatttaggttccaagagttgcca

SEQ ID NO: 5812 - DNA, 50 bp, Homo sapiens
cttcccaaactccattgtctcattctcactgcttatgttattgctcttat

SEQ ID NO: 5813 - DNA, 50 bp, Homo sapiens
cccacacagcagagaagtatcagaaaacatagaaacatgtgaaaatgcgc

SEQ ID NO: 5814 - DNA, 51 bp, Homo sapiens
aggttcaattcattttcctgagatgtttggtttataagatttgaggatggt

SEQ ID NO: 5815 - DNA, 50 bp, Homo sapiens
atacttagatgtgcttggatcctgggtgggaggcttggttagaagtcacg

SEQ ID NO: 5816 - DNA, 50 bp, Homo sapiens
tgggtcagcgtgttcaattttaaataggaatacactagccttacaacgga

SEQ ID NO: 5817 - DNA, 50 bp, Homo sapiens
tgttcatcttgatgtaatagagaaggaaagagagagcatcccttttcagt

SEQ ID NO: 5818 - DNA, 50 bp, Homo sapiens
accagtaacacaatgacggcaagcacagagaaggaaaaagtcagatcccc

SEQ ID NO: 5819 - DNA, 50 bp, Homo sapiens
acttggagctagagagccacccatcatatggaggagaagtggtcactcta

SEQ ID NO: 5820 - DNA, 50 bp, Homo sapiens
tgcatgtgtgttgtgtacttgtctgttctgtaagattgtcggtgttacac

SEQ ID NO: 5821 - DNA, 50 bp, Homo sapiens
ttcctggcagtaaagaaaagaaagaagatgtgagttatgaagcattgact

SEQ ID NO: 5822 - DNA, 51 bp, Homo sapiens
aaataggaatataatctgtccacatcaaagaatgggaagtcgaagtgtaca

SEQ ID NO: 5823 - DNA, 50 bp, Homo sapiens
gttccaaatgttttccgctaatagtttgtcctaaagcctttgccattcct

SEQ ID NO: 5824 - DNA, 50 bp, Homo sapiens
acagagaaggcttatttacgttgggaattacattaaggaaaagtggtgac

SEQ ID NO: 5825 - DNA, 50 bp, Homo sapiens
ccttcctcctatatcctgccttgaatagggatgtgataccttgagccatg

SEQ ID NO: 5826 - DNA, 50 bp, Homo sapiens
atatttgggtctctgtttaagatttcattgccgtggtagggagagttcca

SEQ ID NO: 5827 - DNA, 50 bp, Homo sapiens
tggatgccatgatgacaccaataagcaacccacagattaggggaaatact

SEQ ID NO: 5828 - DNA, 50 bp, Homo sapiens
ggggctgggagccaccaaaagggcctgctcttcggagaaatgctgaattc

SEQ ID NO: 5829 - DNA, 50 bp, Homo sapiens
aggcatcttgaaagttccataaagacagaagtaagggtcattcagtcatt

SEQ ID NO: 5830 - DNA, 50 bp, Homo sapiens
agctaaagccacggaactcaatgagatttatgcatggaaggaaacaggtt

SEQ ID NO: 5831 - DNA, 50 bp, Homo sapiens
tgttctctctcgaactctggagcacatcagctctctctgcataaactgtt

SEQ ID NO: 5832 - DNA, 50 bp, Homo sapiens
atctggaggatggcagtttgagaattaggactaagcccgtctcccctttg

SEQ ID NO: 5833 - DNA, 50 bp, Homo sapiens
cattagctctctaaacatttggcctaagggattcataggtgaagccttta

SEQ ID NO: 5834 - DNA, 50 bp, Homo sapiens
ggtaggatttatccttttcttcatgtgcaactgtataaactggcaaagca

SEQ ID NO: 5835 - DNA, 50 bp, Homo sapiens
agtcttatgggacagagcagctctccagtctaggatggtagaagattctt

SEQ ID NO: 5836 - DNA, 50 bp, Homo sapiens
gagtctgtacccctttctaataaactgctctggacacaatgaaccctgaa

SEQ ID NO: 5837 - DNA, 50 bp, Homo sapiens
ccatcggcaagccttggtgggttcatattcagtggcattagggattaagg

SEQ ID NO: 5838 - DNA, 50 bp, Homo sapiens
ccatttcttctggatcctctcctagttgtctttgtgtggacgcacaagcg

SEQ ID NO: 5839 - DNA, 50 bp, Homo sapiens
gatcctttgctgacactggtttctctcttattttgccccgccaataaaaa

SEQ ID NO: 5840 - DNA, 51 bp, Homo sapiens
tctgtctgaaacttcttttctctctgagaattaaattttccaatggaccgt

SEQ ID NO: 5841 - DNA, 50 bp, Homo sapiens
gatctgtgttttcctcccaaaagaagatcatctttccagaaaaagaggat

SEQ ID NO: 5842 - DNA, 50 bp, Homo sapiens
ttccatatgtcactgtatctgcctggcattaccccttcttaaaacacaca

SEQ ID NO: 5843 - DNA, 50 bp, Homo sapiens
gctcactaccacttcttcaaatccagctaaaagcatcacggcctcaatga

SEQ ID NO: 5844 - DNA, 50 bp, Homo sapiens
gtctggttgttagctttcccgatcctccacacattggaaacctaagcata

SEQ ID NO: 5845 - DNA, 50 bp, Homo sapiens
gggcaatggagccacagactctctaacttcaagaggtgtttcataggtgt

SEQ ID NO: 5846 - DNA, 50 bp, Homo sapiens
agctgaggtcagacaaaccacaacatatatgcagatttatcagcaataaa

SEQ ID NO: 5847 - DNA, 50 bp, Homo sapiens
cctgccagggttgttcggaagtcgcaggtccgaaaatctcctccgcatac

SEQ ID NO: 5848 - DNA, 50 bp, Homo sapiens
cttctctgaaatggtacgcctatacttgcatttctgagaagccaaacaaa

SEQ ID NO: 5849 - DNA, 50 bp, Homo sapiens
agttttctggctaagtcacctcttaaggagatccctgtaaaattcaccct

SEQ ID NO: 5850 - DNA, 50 bp, Homo sapiens
cagattaaaaaccccatcccggccctcaccgaggtgttacaactctgtcc

SEQ ID NO: 5851 - DNA, 50 bp, Homo sapiens
agcaaattactctgcctggaaataaaattctgtcacttcaagcatctcct

SEQ ID NO: 5852 - DNA, 50 bp, Homo sapiens
tccaggcactgtataggtggcgaggacacaatgataggcaaagtagtaca

SEQ ID NO: 5853 - DNA, 50 bp, Homo sapiens
acagacccaaacctcacagagtgaaaggggactttcctcacagagtgaaa

SEQ ID NO: 5854 - DNA, 51 bp, Homo sapiens
ttgcttcagacttttaacaacaatcctagaagccagaaaacaatgaagaaa

SEQ ID NO: 5855 - DNA, 50 bp, Homo sapiens
ttctgtcagggcttcaaaagagacttccatagttttgggaactggagtca

SEQ ID NO: 5856 - DNA, 50 bp, Homo sapiens
gatatattgaaggtcagaggcagagctaaacaggtgatgccactgggtct

SEQ ID NO: 5857 - DNA, 50 bp, Homo sapiens
aggctcttgttgagtattcctttgattcctgcttctgtctttttaaatca

SEQ ID NO: 5858 - DNA, 50 bp, Homo sapiens
acacaccaaaagaaatagaagagtctttttctgcccttggggaatctgca

SEQ ID NO: 5859 - DNA, 50 bp, Homo sapiens
acacccagcacccacagggaagaaataattccacagagctaagtattcca

SEQ ID NO: 5860 - DNA, 50 bp, Homo sapiens
tgtgcctgtgtgctccagcctcttcctatgtgtgtaacttcaataaaacc

SEQ ID NO: 5861 - DNA, 50 bp, Homo sapiens
accgagtgttaccgcaagaggtgtaaaaatccaggttcatgtttgcacac

SEQ ID NO: 5862 - DNA, 50 bp, Homo sapiens
tcctgattctcaaagtacccccttccctacaactctaacatgctttgtct

SEQ ID NO: 5863 - DNA, 50 bp, Homo sapiens
ccatgatttttccaatggacaagcactattaacatgggactgtatttcct

SEQ ID NO: 5864 - DNA, 50 bp, Homo sapiens
aatagaactgatagcccatgatgattggctggcagggttaaggaagtggg

SEQ ID NO: 5865 - DNA, 50 bp, Homo sapiens
tcccaggagagtcacatttctttttcactaaataaggaggggaagaaaaa

SEQ ID NO: 5866 - DNA, 50 bp, Homo sapiens
gggttacctcactttctaggttcccaagattcccaagttaaggaagcttt

SEQ ID NO: 5867 - DNA, 50 bp, Homo sapiens
aaagcgtccagtccccctaactcaaacacagaaacataacaattttacaa

SEQ ID NO: 5868 - DNA, 50 bp, Homo sapiens
cccagggctcctccacctgaaagaattgtcagggtttcagatcagctaaa

SEQ ID NO: 5869 - DNA, 50 bp, Homo sapiens
tggcctccacccattaaactgtctttgcctaagacaaataattcccagga

SEQ ID NO: 5870 - DNA, 50 bp, Homo sapiens
tgtactcctgatgcctgaaaatcgttaagtgaagacttatcacattaccg

SEQ ID NO: 5871 - DNA, 50 bp, Homo sapiens
atccttcagattgagctgggtgtcagcattcaattccacaaggctacctg

SEQ ID NO: 5872 - DNA, 50 bp, Homo sapiens
tggataagcaatatgttggactagtatgaaaatggcattcccagcagtga

SEQ ID NO: 5873 - DNA, 50 bp, Homo sapiens
tcactagcagaatatagtgggcatgaccagtatcctagtagagctgaccc

SEQ ID NO: 5874 - DNA, 50 bp, Homo sapiens
agtttctttcttacaatgggggtctgaaatccagggtttccacaccaggg

SEQ ID NO: 5875 - DNA, 50 bp, Homo sapiens
ccaaatacttagtgtagttgacttgtcttgggttgcactgtaaggcagag

SEQ ID NO: 5876 - DNA, 50 bp, Homo sapiens
caagagtttccatgcgtccagtgatgaccggaattaatcatgtatggtgt

SEQ ID NO: 5877 - DNA, 51 bp, Homo sapiens
gtttctaacccataagtgcctcatacatacattgctagtctaaagagcttt

SEQ ID NO: 5878 - DNA, 50 bp, Homo sapiens
accggctaattttgtaactggcttgtttgtaaaataaatccttcctgtgt

SEQ ID NO: 5879 - DNA, 50 bp, Homo sapiens
tggtgggactatgtgttattcttgtatacttgcagtgggtagatgtcact

SEQ ID NO: 5880 - DNA, 50 bp, Homo sapiens
acttccctacctcacaggttaggattcaaagtgtgtattcccccattgtg

SEQ ID NO: 5881 - DNA, 50 bp, Homo sapiens
gggtgctttacaggattcttggaaatgtgtagtggatgctggctctaggg

SEQ ID NO: 5882 - DNA, 50 bp, Homo sapiens
acagaagcagggggtcagaaagtttcataaaggaggtgtcttggaacaaa

SEQ ID NO: 5883 - DNA, 50 bp, Homo sapiens
ctattgtgtgggttgccttgtcctactcaacttcaaatattcaccacccc

SEQ ID NO: 5884 - DNA, 50 bp, Homo sapiens
caggtgtgcttactggcaggaaccgagggaataaataaagatcactggaa

SEQ ID NO: 5885 - DNA, 50 bp, Homo sapiens
accagccttatgtgtgtgggtattcaatactctgcacattatatactgta

SEQ ID NO: 5886 - DNA, 50 bp, Homo sapiens
gggcatttgttaccccctcctcaccaccatccccattaaaggcttcgggg

SEQ ID NO: 5887 - DNA, 50 bp, Homo sapiens
ctgtatctacaactcctgacttcagatttttgctttcttcaaaacagcct

SEQ ID NO: 5888 - DNA, 50 bp, Homo sapiens
agcaagacttaaccactaattactattatctgacccaggaaaactccgcc

SEQ ID NO: 5889 - DNA, 50 bp, Homo sapiens
tggatagttgctcaatgtagcagtgatgttcttggaattgccagcagagc

SEQ ID NO: 5890 - DNA, 50 bp, Homo sapiens
ccaacagattcgtgcttaccctgaggtgaagcctcgtttgagaaccaaat

SEQ ID NO: 5891 - DNA, 50 bp, Homo sapiens
caaccttcttgttgaattgatttactactcatcagggtcatgcacaagca

SEQ ID NO: 5892 - DNA, 50 bp, Homo sapiens
acattcaaactgccagaatatgactgtaaaacagcgaagtgttctcttgc

SEQ ID NO: 5893 - DNA, 50 bp, Homo sapiens
tcttcctgggaatgtgatgtgtttttcactggttctaattctgtcttcct

SEQ ID NO: 5894 - DNA, 50 bp, Homo sapiens
acttattaattctcacctcagcctcagggatgtatgtagggaaggagcat

SEQ ID NO: 5895 - DNA, 50 bp, Homo sapiens
acattcctgtcattagtgaataagaagctgaggtgtgactaagaagacaa

SEQ ID NO: 5896 - DNA, 52 bp, Homo sapiens
cctccttgataaaatcaagaacaggttagattaaagcagtaaatcctagact

SEQ ID NO: 5897 - DNA, 50 bp, Homo sapiens
tcctggcctttgtgggtttttaattccctttaccttttccctttttggat

SEQ ID NO: 5898 - DNA, 50 bp, Homo sapiens
actgctgcaactacaattctcagatagtcccatttgtttaaatcacgcat

SEQ ID NO: 5899 - DNA, 50 bp, Homo sapiens
ccttccctcttgcctgtaggttctgtggctataaacaaatcataactttt

SEQ ID NO: 5900 - DNA, 50 bp, Homo sapiens
ttaaatgcttccctggctctccctgggtttcagtttctatccatgccctg

SEQ ID NO: 5901 - DNA, 50 bp, Homo sapiens
ttgttctcctcccaagtctctggttctatttggctttttcagctctgtgc

SEQ ID NO: 5902 - DNA, 50 bp, Homo sapiens
gcatttcagggacacaaatggtccatggcagagaccagtaatgccagata

SEQ ID NO: 5903 - DNA, 50 bp, Homo sapiens
ttttatccccgctttaactttgtttgcttggtacttttcttgtggttaca

SEQ ID NO: 5904 - DNA, 50 bp, Homo sapiens
cacgcacccaactccccactgctcctctccatccagatgttcgtccagag

SEQ ID NO: 5905 - DNA, 50 bp, Homo sapiens
tttgagggcaatttaatggttaagtgtaggaaaatccactcttacagtgt

SEQ ID NO: 5906 - DNA, 50 bp, Homo sapiens
ggccttttgattttccattggggtcccccgctttcccatttttggttttt

SEQ ID NO: 5907 - DNA, 50 bp, Homo sapiens
gacagtttggggaagggattgaaggtctgcgtcaaagagaacagaaaacc

SEQ ID NO: 5908 - DNA, 51 bp, Homo sapiens
aggggccttttaccggtttgttttcccttaaatttttaaaggaattgaatt

SEQ ID NO: 5909 - DNA, 50 bp, Homo sapiens
tcctctttcttgtcactgtgaagcgatgaataaacctgggtgtagatcca

SEQ ID NO: 5910 - DNA, 50 bp, Homo sapiens
cctagaaattattatacagggataaatgaggcactgaaggtgggagaacc

SEQ ID NO: 5911 - DNA, 50 bp, Homo sapiens
acgacaaactgcacagtaaatatcacaaacacggaaataccacagtgtct

SEQ ID NO: 5912 - DNA, 50 bp, Homo sapiens
accatgacttggcaaagagtttcaagagagggcataatcaaaagtaacca

SEQ ID NO: 5913 - DNA, 50 bp, Homo sapiens
gattaatcaagggaagagcttcaagcagagctccttaggtttttcaaaaa

SEQ ID NO: 5914 - DNA, 50 bp, Homo sapiens
gctcaggggacagctattctttttcaaagcgtttaccgactggatcacct

SEQ ID NO: 5915 - DNA, 50 bp, Homo sapiens
tgagagctttccttcctcctacgatccaaccatgtcaaacatttcctaca

SEQ ID NO: 5916 - DNA, 50 bp, Homo sapiens
tgtgccaacgcatgatttctttgagtaaatttctaaacgtcacagaagtt

SEQ ID NO: 5917 - DNA, 50 bp, Homo sapiens
agtcaacatggagcaagtgagctaaggaagtaatggaaactgtttggaga

SEQ ID NO: 5918 - DNA, 50 bp, Homo sapiens
agctcaggtcttccctcatctgttagtttcctggagtctgttctcatact

SEQ ID NO: 5919 - DNA, 50 bp, Homo sapiens
aaacatactcctcttcaccagcactcagacatttgtatccagagaaagct

SEQ ID NO: 5920 - DNA, 50 bp, Homo sapiens
agtctgtcaattgtttaagcctgtgatctttcttttcccagttaagagtt

SEQ ID NO: 5921 - DNA, 50 bp, Homo sapiens
tgtcctctcaaccctacttgtggttttacactgttaattacactatttgc

SEQ ID NO: 5922 - DNA, 50 bp, Homo sapiens
gtgtgtgtatggttgttgggcgtaggacaggtttcggggatgcgcggtac

SEQ ID NO: 5923 - DNA, 50 bp, Homo sapiens
ctgtgcttgactattgaaaacttagaattgggatgccaaagttacttcct

SEQ ID NO: 5924 - DNA, 50 bp, Homo sapiens
ggttgtatcaaaagaactccacatccatattgaataaactcccactagcc

SEQ ID NO: 5925 - DNA, 50 bp, Homo sapiens
ggctgcccagatctcgtgggaagaagaccacaggaggactcggctcaatg

SEQ ID NO: 5926 - DNA, 50 bp, Homo sapiens
tggaaaaatgatagcagccaacttgacagaagaacccagcatacacattc

SEQ ID NO: 5927 - DNA, 50 bp, Homo sapiens
ttggttttggggattgggaagtcttaagccaaattgtccccggtctcccc

SEQ ID NO: 5928 - DNA, 50 bp, Homo sapiens
gccctatatctagtgagcaggttgtggcaatcaggaagggattgatattt

SEQ ID NO: 5929 - DNA, 50 bp, Homo sapiens
tgcacgcaatgcttgaagtgttcccaggtatttagtttcaggtaaatttt

SEQ ID NO: 5930 - DNA, 50 bp, Homo sapiens
ctgtaggtatgagctgccaggatccaggtgtgactcgggtatttctaggg

SEQ ID NO: 5931 - DNA, 50 bp, Homo sapiens
tcccatttggggggtgggctgtttaaattttgactccctgttttaaaccc

SEQ ID NO: 5932 - DNA, 50 bp, Homo sapiens
ccacttgcatctcttctgggggttctttcctttctttcctgttctaaggc

SEQ ID NO: 5933 - DNA, 50 bp, Homo sapiens
tgggtaatcaacactcaaccatcaacaaacactctctattccaggcactg

SEQ ID NO: 5934 - DNA, 50 bp, Homo sapiens
aggagaaataattagagtggcacactagcatgatggtaaacattctgtca

SEQ ID NO: 5935 - DNA, 50 bp, Homo sapiens
aggagttcaagaagcagagatttccaggtccatgcaccaaagctcatgtg

SEQ ID NO: 5936 - DNA, 50 bp, Homo sapiens
cttgtcctctcctgatccagggctccagtgcccatgtccagtgccttggt

SEQ ID NO: 5937 - DNA, 50 bp, Homo sapiens
gcatctccccgctgtcagcctcagccctctcctaccaaaatctctttcga

SEQ ID NO: 5938 - DNA, 50 bp, Homo sapiens
ggcgtttcccattgaccagtttgaccctggtttgaataaagagaagtgcg

SEQ ID NO: 5939 - DNA, 50 bp, Homo sapiens
agcccattgaaaaccttggcaaaatgtcagaccttaagactttccactat

SEQ ID NO: 5940 - DNA, 50 bp, Homo sapiens
tcagagacaacggaagctgaaaaataagagctgagaaaggaagaactttt

SEQ ID NO: 5941 - DNA, 50 bp, Homo sapiens
atatacatacaaatctaagctccaagaagcctaagaaaaccccttagggg

SEQ ID NO: 5942 - DNA, 50 bp, Homo sapiens
gggcaatttacatcgggactcgtttcatctctagaccttcacttacctga

SEQ ID NO: 5943 - DNA, 50 bp, Homo sapiens
agctctggagtgcccctccctccaaataaagtattttaagcgaacactga

SEQ ID NO: 5944 - DNA, 50 bp, Homo sapiens
gccagtctctatgtgtcttaatcccttgtccttcattaaaagcaaaacta

SEQ ID NO: 5945 - DNA, 50 bp, Homo sapiens
ccctcaggcatagaaattgaatctgaaatggctgatgaataagcaaaggc

SEQ ID NO: 5946 - DNA, 50 bp, Homo sapiens
cagccctgcctgagtttttgacacctgcatccctccctgcctcacctcac

SEQ ID NO: 5947 - DNA, 50 bp, Homo sapiens
agagcaggagaaatcctactgcattattaatctgaaagcacaaggacagc

SEQ ID NO: 5948 - DNA, 50 bp, Homo sapiens
ctgtcttggtttgtatgggaaaatctgcgggttgtggaatattaggttct

SEQ ID NO: 5949 - DNA, 50 bp, Homo sapiens
tgggattatagggggagacaggagttgtggaattacaggagaggttcact

SEQ ID NO: 5950 - DNA, 50 bp, Homo sapiens; identical to SEQ ID NO: 5949

SEQ ID NO: 5951 - DNA, 50 bp, Homo sapiens
ctgagaaaaggagtgtctctcttctgctcccaaacttccagtagcttcca

SEQ ID NO: 5952 - DNA, 50 bp, Homo sapiens
tcgaggttcttcccaagaaaagcccaatcttataaactgttacttcccct

SEQ ID NO: 5953 - DNA, 50 bp, Homo sapiens
tgcaatgaggcagtggggtaaggttaaatcctctaaccgtctttgaatca

SEQ ID NO: 5954 - DNA, 50 bp, Homo sapiens
tggcaacttcaactccttgatggcgataatctctggtatgaatatgagcc

SEQ ID NO: 5955 - DNA, 50 bp, Homo sapiens
ttgtgctcctgatacgacgttgccacagttaatccgttctgatctctgct

SEQ ID NO: 5956 - DNA, 50 bp, Homo sapiens
caagcctaactttccaacactcccgcgacgcaaccccttcccctttcctc

SEQ ID NO: 5957 - DNA, 50 bp, Homo sapiens
cacggttagagtcaccaaacctgtatttcaggggacatctttccagctcc

SEQ ID NO: 5958 - DNA, 50 bp, Homo sapiens
ccaaaggctcactacccctgtgcgttgtccagcacacagacactatgtgc

SEQ ID NO: 5959 - DNA, 50 bp, Homo sapiens
tgcttgggaaatttggtttgtaaacctaaaatagcccttatttctgggga

SEQ ID NO: 5960 - DNA, 50 bp, Homo sapiens
catctgctgagcagtgtgctgtgtcaacctcctcctaggtctcctctatg

SEQ ID NO: 5961 - DNA, 50 bp, Homo sapiens
ctttctgcctgaagctgcccccatgactcccttctttgtgcaaaagcatg

SEQ ID NO: 5962 - DNA, 50 bp, Homo sapiens
gaaatgagttggtgtcttcacagaatgaggatccccagagccatcttgcc

SEQ ID NO: 5963 - DNA, 50 bp, Homo sapiens
gtctccctcccactctctgccttacctggtatctatgactcgactgaaat

SEQ ID NO: 5964 - DNA, 50 bp, Homo sapiens
tgcgagaggaagcagagaccaccttgaaactcgggtgcattaagtccttg

SEQ ID NO: 5965 - DNA, 50 bp, Homo sapiens
ttagccactgctattctaggttccttgatggagccccactcccacgccta

SEQ ID NO: 5966 - DNA, 50 bp, Homo sapiens
accacccagaggttgctggcttccttaataaagctaactttcctttcacc

SEQ ID NO: 5967 - DNA, 50 bp, Homo sapiens
aggggagccagtggtttttggtcatgggaagtgttctcataaaattcatt

SEQ ID NO: 5968 - DNA, 50 bp, Homo sapiens
gcaccagacttctgaacaggctgggagagtgaggcataaacacatgaaat

SEQ ID NO: 5969 - DNA, 50 bp, Homo sapiens
acacagtactttgttgagatgttggcttcttggtttatggcatgaattct

SEQ ID NO: 5970 - DNA, 50 bp, Homo sapiens
acttatcttttgccacccatgttcctggatgccttgccttcctctttcat

SEQ ID NO: 5971 - DNA, 50 bp, Homo sapiens
aaacaggaagcctctcatgaatttgaccaaggagctacattcgttctcta

SEQ ID NO: 5972 - DNA, 50 bp, Homo sapiens
tgaggaagaggagatttattaagccccttcttttaggctaggaggtttcc

SEQ ID NO: 5973 - DNA, 50 bp, Homo sapiens
ggacactggcttttgtgcagctcttcatcacagagtctgttgagctacaa

SEQ ID NO: 5974 - DNA, 50 bp, Homo sapiens
acagtgattttcaaccaaggggctttttcaaactacattccttagctccc

SEQ ID NO: 5975 - DNA, 50 bp, Homo sapiens
ggtggtggctacaagggtgattgccttatgataattgaccgtgtcataat

SEQ ID NO: 5976 - DNA, 50 bp, Homo sapiens
agctgggaggccattactttttgtctgagtcttctggagttctagcaaaa

SEQ ID NO: 5977 - DNA, 50 bp, Homo sapiens
agttgcattaaactgagcttagatgtgtaagtttgctaacggatgggttt

SEQ ID NO: 5978 - DNA, 50 bp, Homo sapiens
cctctaaggcatttatttactgacaacataaaatcttgaaccccaggtca

SEQ ID NO: 5979 - DNA, 50 bp, Homo sapiens
tcacctccatcaacttactagcacataaagggtgggatttcatgtgttga

SEQ ID NO: 5980 - DNA, 50 bp, Homo sapiens
ctggcaaaggcatgggtacaacctgctctgtgatctaccttctgaaccac

SEQ ID NO: 5981 - DNA, 50 bp, Homo sapiens
acacctgtggtatatttgtatcattcagtctggtttctcacccttcctaa

SEQ ID NO: 5982 - DNA, 50 bp, Homo sapiens
aaccctcgtaaggtttcatcttccttgattgcaaaatgagtttgtgtgaa

SEQ ID NO: 5983 - DNA, 50 bp, Homo sapiens
cccgcttcaccttccctaaataactcgtttgcaggctaattccatcaaat

SEQ ID NO: 5984 - DNA, 50 bp, Homo sapiens
attttgctcattacctgtcaggagaaaaccctccttccccagtctccact

SEQ ID NO: 5985 - DNA, 50 bp, Homo sapiens
acctactgaatctccagattgccaagtgaaacacaatggttgcctcttca

SEQ ID NO: 5986 - DNA, 50 bp, Homo sapiens
tgcgaaagctaattccctagtatgaataaacttcagaccttgctctcctt

SEQ ID NO: 5987 - DNA, 50 bp, Homo sapiens
agcctgaggtgggtgaagaaaatacctgctttatactgttctggaaactc

SEQ ID NO: 5988 - DNA, 50 bp, Homo sapiens
cttttccccttcatggtagttgctgcttaagtttctctaacatgcctgca

SEQ ID NO: 5989 - DNA, 50 bp, Homo sapiens
tgaatgtgcagatgcagaacccattgatatggagggctgagtgtctgaaa

SEQ ID NO: 5990 - DNA, 51 bp, Homo sapiens
tgtactacttatttatgtgtaaaccatacacagggctagaaaggaagggat

SEQ ID NO: 5991 - DNA, 50 bp, Homo sapiens
tgtagaattgcggagtagaaagacccttgaaagatcatttgtcctgtggt

SEQ ID NO: 5992 - DNA, 50 bp, Homo sapiens
gctcaagttcccagcacctggggaattctaagcctgaggaagacaaggtg

SEQ ID NO: 5993 - DNA, 50 bp, Homo sapiens
tgtttttatgtcctgagcaagcaaattgctgcaattaaaatcaccaattt

SEQ ID NO: 5994 - DNA, 51 bp, Homo sapiens
aggcctgatattgaaagcttttgatactgagatcctattaatctcagatga

SEQ ID NO: 5995 - DNA, 50 bp, Homo sapiens
tgttagtttgcttttgaaattctttggagggtactcttcagggcttcaca

SEQ ID NO: 5996 - DNA, 51 bp, Homo sapiens
tagtgattatctccaggaatcaagtacaaactttgaaaaaagactggaggt

SEQ ID NO: 5997 - DNA, 50 bp, Homo sapiens
tttgtcccaagggctcagactgaaagaatgcaatgtgagaggtatgccac

SEQ ID NO: 5998 - DNA, 50 bp, Homo sapiens
tctgtgaaaatctttctgcaaatgtctttgcttgcttgtactcacgtttt

SEQ ID NO: 5999 - DNA, 50 bp, Homo sapiens
tgtctttaacgcacagatgttacttcagcaccacaaggactgttgatgga

SEQ ID NO: 6000 - DNA, 50 bp, Homo sapiens
cagtcagatgttggaattgggggtagagggattatagagttgtgtgtgct

SEQ ID NO: 6001 - DNA, 50 bp, Homo sapiens
aaaggagggactatggcatcaaacagcctcttcagcacagtgacaccatg

SEQ ID NO: 6002 - DNA, 50 bp, Homo sapiens
acccagtttgtgcatagttcatgatcctctataaaaccagcttttgtgga

SEQ ID NO: 6003 - DNA, 50 bp, Homo sapiens; identical to SEQ ID NO: 4877

SEQ ID NO: 6004 - DNA, 50 bp, Homo sapiens
tggaatggactcttaaaacaatgaaagagcatttatcgtttgtcccttga

SEQ ID NO: 6005 - DNA, 50 bp, Homo sapiens
tcactaccttcaattgtttacaaggtggatatgggcaggcaacagatact

SEQ ID NO: 6006 - DNA, 50 bp, Homo sapiens
ctaggccggatgggccagagaaggagaaccatggcaggagccggaagcag

SEQ ID NO: 6007 - DNA, 50 bp, Homo sapiens
aaatgttgagcaactgttcaataacagcactaattgtgtgttcattggct

SEQ ID NO: 6008 - DNA, 50 bp, Homo sapiens
ctggcacatccaggttttagagcaggcagcctgagatttcaaaaatgagg

SEQ ID NO: 6009 - DNA, 50 bp, Homo sapiens
ggagcggaatacagtaaaagcactggactgacctaagagtttgtttctgc

SEQ ID NO: 6010 - DNA, 50 bp, Homo sapiens
acaccatttcagcgttggatcacagacagctcttcctttatatcccagca

SEQ ID NO: 6011 - DNA, 50 bp, Homo sapiens
ccaccttgctgccttttgaaacactcaggaaatatagttggctaaaactg

SEQ ID NO: 6012 - DNA, 50 bp, Homo sapiens
cacttcgcaacggagtgtttgaaattgtggtggtcctgatttataggatt

SEQ ID NO: 6013 - DNA, 50 bp, Homo sapiens
gctttggcagatggattaaccttgttcttttggagccagatcaatatcta

SEQ ID NO: 6014 - DNA, 50 bp, Homo sapiens
agaatgcctggttttcgtttgcaatttgcttgtgtaaatcaggttgtaaa

SEQ ID NO: 6015 - DNA, 50 bp, Homo sapiens; identical to SEQ ID NO: 1006

SEQ ID NO: 6016 - DNA, 50 bp, Homo sapiens
tgcaagtggatggtttggtatcactgtaaataaaaagagggcctgggaaa

SEQ ID NO: 6017 - DNA, 50 bp, Homo sapiens
gtggcttttctgttgacgccaaaggttactccctctgcctcaccataaaa

SEQ ID NO: 6018 - DNA, 50 bp, Homo sapiens
acctcctacgtctgttttctggctgtggtgacttgggatttttaacctta

SEQ ID NO: 6019 - DNA, 50 bp, Homo sapiens
atcgttggattatctttgaacccccttgtgtggatcattttgagccgcct

SEQ ID NO: 6020 - DNA, 50 bp, Homo sapiens
agctccaaagtggtttgatgaccacaggctaaaattcatagtcttaaaat

SEQ ID NO: 6021 - DNA, 50 bp, Homo sapiens
tcagaaaggagaaaacacagaccaaagagaagtatctaagaccaaaggga

SEQ ID NO: 6022 - DNA, 50 bp, Homo sapiens
gcatcacgatttgtctacataagtccagttcatctcgcgtttgttttggc

SEQ ID NO: 6023 - DNA, 50 bp, Homo sapiens
atacagggttccatccagaaagcattcagtcagagcaagttaaagtcagt

SEQ ID NO: 6024 - DNA, 50 bp, Homo sapiens
aagtgccagattttgataatcaccagcctctcattcaactcctatgttgc

SEQ ID NO: 6025 - DNA, 50 bp, Homo sapiens
acccttggtcactggtgtttcaaacattctggcaagtcacatcaatcaag

SEQ ID NO: 6026 - DNA, 50 bp, Homo sapiens
agctctggagcctttgcttcctcaaatacgagcgggaactgcgttgagcg

SEQ ID NO: 6027 - DNA, 50 bp, Homo sapiens
aagttgtcctgtgctaaagcaagcgtgggatgatcctacctacctctagg

SEQ ID NO: 6028 - DNA, 50 bp, Homo sapiens
atttggacagatgcagaaggaactgttagtgagtcaagacaaacacatct

SEQ ID NO: 6029 - DNA, 50 bp, Homo sapiens
cccctacccctggaaagtaatatactgaagtctcatcatactgttttggg

SEQ ID NO: 6030 - DNA, 50 bp, Homo sapiens; identical to SEQ ID NO: 1043

SEQ ID NO: 6031 - DNA, 50 bp, Homo sapiens
agctagtgatgttttgtccaaaggaagattctgacaacagcttcagcaga

SEQ ID NO: 6032 - DNA, 50 bp, Homo sapiens
acacagacatattgaccgcacacaacactgaaatggactgacttgagaaa

SEQ ID NO: 6033 - DNA, 50 bp, Homo sapiens; identical to SEQ ID NO: 4348

SEQ ID NO: 6034 - DNA, 50 bp, Homo sapiens
ggtccatgtcaccgtgagtacacccctatgattggtttgttgtcaagaag

SEQ ID NO: 6035 - DNA, 50 bp, Homo sapiens
tgctagttcaggtcctccaggcattgatttgtacagttaaactccgagtg

SEQ ID NO: 6036 - DNA, 50 bp, Homo sapiens; identical to SEQ ID NO: 4210

SEQ ID NO: 6037 - DNA, 50 bp, Homo sapiens
ggcctactgaccaaattgttgtgttgagatgatatttaactttttgccaa

SEQ ID NO: 6038 - DNA, 50 bp, Homo sapiens; identical to SEQ ID NO: 4297

SEQ ID NO: 6039 - DNA, 50 bp, Homo sapiens
cgatagaattgaagcagtccacggggaggggatgatacaaggagtaaacc

SEQ ID NO: 6040 - DNA, 50 bp, Homo sapiens
atagactccaaagaggcgttaagcacctggttttcctttggctcagaaaa

SEQ ID NO: 6041 - DNA, 50 bp, Homo sapiens
ctcaaacgaaattgggcaggccatttgcgtggtttctctggataagttcc

SEQ ID NO: 6042 - DNA, 50 bp, Homo sapiens
gcacatgacagtaagcgaggttttgggtaaatatagatgaggatgcctat

SEQ ID NO: 6043 - DNA, 50 bp, Homo sapiens
tcccagagtaactgacagtatcaaatagcaagagagttaggatgaggact

SEQ ID NO: 6044 - DNA, 50 bp, Homo sapiens
acacaggaaccgcttacccaccagctctgcccgcgtctctaccgccatag

SEQ ID NO: 6045 - DNA, 50 bp, Homo sapiens
ttcttccaagagaataaccctattaaaggctaaaaatggaagctcccagt

SEQ ID NO: 6046 - DNA, 50 bp, Homo sapiens
actgacctagcagatgtgtggaaaaggaatcagatcttgattcttctggg

SEQ ID NO: 6047 - DNA, 50 bp, Homo sapiens
acaactcaagtgaaaagatgtctccagtttctgaagataacgcacgctga

SEQ ID NO: 6048 - DNA, 50 bp, Homo sapiens
cgccgactcgttgaaagttttgttgtgtagttggttttcgttgagttctt

SEQ ID NO: 6049 - DNA, 50 bp, Homo sapiens
cacccacctggtaggaaggtcaatcttatgctcagaagtcccacccacca

SEQ ID NO: 6050 - DNA, 50 bp, Homo sapiens
caactccttaaagggttgaaggttgtgacaataactgagggaactgatgt

SEQ ID NO: 6051 - DNA, 50 bp, Homo sapiens
aaaacactccacctaaaagcaggaaagatggcaattctaaatagcagcta

SEQ ID NO: 6052 - DNA, 53 bp, Homo sapiens
ggaggttttgatcgtgactttattttgagatattgtatctttgttagtattgc

SEQ ID NO: 6053 - DNA, 50 bp, Homo sapiens
ttgtaaggttccggggaactgactcaacatggttctccaactcgaggttg

SEQ ID NO: 6054 - DNA, 50 bp, Homo sapiens
tgtgagtgttataggttacagtggattccaaactagccacaagtgaagca

SEQ ID NO: 6055 - DNA, 50 bp, Homo sapiens
tcagccaggaggaaaagcactctgattatgaattgagcagaaggaaacaa

SEQ ID NO: 6056 - DNA, 50 bp, Homo sapiens
gttcccactcgttcttgccggagaaacctgccttttcaagcataattcaa

SEQ ID NO: 6057 - DNA, 50 bp, Homo sapiens
gggtccaagattattgattaatttgggcaccgcgagagctcgagtccccc

SEQ ID NO: 6058 - DNA, 50 bp, Homo sapiens
gaccacctgtaaagcaagtcctttcaagtttcactgcacatcccaaacca

SEQ ID NO: 6059 - DNA, 50 bp, Homo sapiens
tggtccactgtcactgtttctctgctgttgcaaatacatggataacacat

SEQ ID NO: 6060 - DNA, 50 bp, Homo sapiens
agactctggaaaaggagggtcggagtattaaactggctgggaatgagagg

SEQ ID NO: 6061 - DNA, 50 bp, Homo sapiens
tgagagcacaccataaattcacagcaggaataaacgaagacacacgagca

SEQ ID NO: 6062 - DNA, 50 bp, Homo sapiens
acattctctcattttgctgaagctgatttgattgggtgtctgtttctcgc

SEQ ID NO: 6063 - DNA, 50 bp, Homo sapiens
tgagaaggtaaagtagaaagggaagatgatgagtgaacaataagccttgt

SEQ ID NO: 6064 - DNA, 50 bp, Homo sapiens
acattattccatgggaataagtcatcagtgcaaaggactgtaaggagtgc

SEQ ID NO: 6065 - DNA, 50 bp, Homo sapiens
cgccgctcctggagacctgataacttaggcttgaaataattgacttgtct

SEQ ID NO: 6066 - DNA, 50 bp, Homo sapiens
tgtatgtgcaatatgcttatgggtaattatgggcaagagaaatggaaaca

SEQ ID NO: 6067 - DNA, 50 bp, Homo sapiens
accccttggtaaagcagttgtaagaattaaacaagaggaattgctctttc

SEQ ID NO: 6068 - DNA, 50 bp, Homo sapiens
aaatcaggccccttgcgccattcacaaaaatccttgtgagatgactcaag

SEQ ID NO: 6069 - DNA, 50 bp, Homo sapiens
agggcagaggtcctttgggagggtaagctcacaaaaactcagggaggcag

SEQ ID NO: 6070 - DNA, 50 bp, Homo sapiens
tcatctccgccaaggttcccactaggcaggaaaggatttttatctaaagt

SEQ ID NO: 6071 - DNA, 50 bp, Homo sapiens
ccacccaagtcggaatccgagtgaaataaatagcatcgcccgccaactac

SEQ ID NO: 6072 - DNA, 50 bp, Homo sapiens
aggcacacgattgtcaccatttctccctttacaagctgtataatcagtaa

SEQ ID NO: 6073 - DNA, 50 bp, Homo sapiens
gcaacgtctgaatgtagtaatgtgactcagagcttcaaagtaagcattcg

SEQ ID NO: 6074 - DNA, 50 bp, Homo sapiens
gccaccccatctgggaggcccagcatccaattcagtcgccttcaatgatt

SEQ ID NO: 6075 - DNA, 50 bp, Homo sapiens
tgatagactggatgctgctatggtaatctgcctcaggaaaatgccggact

SEQ ID NO: 6076 - DNA, 50 bp, Homo sapiens
tggagccaagaagccactgactcaagaggatttcaagcgagagctgcttg

SEQ ID NO: 6077 - DNA, 50 bp, Homo sapiens
caacttttgtaacaggggacttagccgggggcaggaggggttcttgagac

SEQ ID NO: 6078 - DNA, 50 bp, Homo sapiens
acttgaaggcacatcttccttttggttgttttccatcttcaaattaaact

SEQ ID NO: 6079 - DNA, 51 bp, Homo sapiens
taaaaactgacatgacatgagatggtttaagtgtcaaacataagggtcttt

SEQ ID NO: 6080 - DNA, 50 bp, Homo sapiens
actgacataagcccacttcaggtgtttggaagacactaaagagaatcaga

SEQ ID NO: 6081 - DNA, 50 bp, Homo sapiens
gcagctttttgctggcgggggtctaaataaagtagcttccccaaaagaaa

SEQ ID NO: 6082 - DNA, 50 bp, Homo sapiens
acctggttatctcgcaatgacctagctaacacaaatgcaacatcagccgg

SEQ ID NO: 6083 - DNA, 50 bp, Homo sapiens
tgatcaaaatgaagatgctccaaccgtataaatggcagatgaaatagact

SEQ ID NO: 6084 - DNA, 50 bp, Homo sapiens
gcaggagagaaataccttctaatgggtgtggacactggaggaactgttac

SEQ ID NO: 6085 - DNA, 50 bp, Homo sapiens
agggcactgtttgttcctttaatatggagaaatatcgcaaataactggga

SEQ ID NO: 6086 - DNA, 50 bp, Homo sapiens
ttggcctatgttaatttctattctcagttcttctgtgcccttcctcctct

SEQ ID NO: 6087 - DNA, 50 bp, Homo sapiens
gaacgtaagcccgacgctaggcagtgctgttagaaagtgatttggaagag

SEQ ID NO: 6088 - DNA, 50 bp, Homo sapiens
atcccattctccctctcaaggcaggggtcatagatcctaagccataaaat

SEQ ID NO: 6089 - DNA, 50 bp, Homo sapiens
tgctgtaaaatggcagctccataggaacctattttccataggaacctgca

SEQ ID NO: 6090 - DNA, 50 bp, Homo sapiens
actggagaaaggtgtcttcctgtcctttcaggggctcctgcggggaattc

SEQ ID NO: 6091 - DNA, 50 bp, Homo sapiens
attatatttgtccctatcagaatcctcgaatccctagcagccagtccctg

SEQ ID NO: 6092 - DNA, 50 bp, Homo sapiens
tgctcactgtcttctggaagagacaagcactttcttgaaattcctaagca

SEQ ID NO: 6093 - DNA, 50 bp, Homo sapiens
caatcggatcattcttctcaacttgggcggctctttcctcccttccttcc

SEQ ID NO: 6094 - DNA, 50 bp, Homo sapiens
tgctttgggcagtagctgaagccgaagtatgaacagtccattttgtttct

SEQ ID NO: 6095 - DNA, 50 bp, Homo sapiens
cacagttgagtaggaggtcatgaagaagaagagatgatacctgccttacc

SEQ ID NO: 6096 - DNA, 50 bp, Homo sapiens
tttgtgtagcaaatgttcattaattgcctactttgtgccaaattcaggcc

SEQ ID NO: 6097 - DNA, 50 bp, Homo sapiens
tccagcattgtattgtctattgacacacaaagtttgaaaataaaggggca

SEQ ID NO: 6098 - DNA, 50 bp, Homo sapiens
cacccaccagaccgaggattccaaaagggggcgaaggcggagagcaaagg

SEQ ID NO: 6099 - DNA, 50 bp, Homo sapiens
tggactctgttttcaagaggaagaaacaactgacaaataagttgatgtca

SEQ ID NO: 6100 - DNA, 50 bp, Homo sapiens
atgttgaaactggttttaacttgtaatggtgtggctgatgttacccgacc

SEQ ID NO: 6101 - DNA, 50 bp, Homo sapiens
acacagatttgaagtctactgttctaaatggcctctacttcctgctgtca

SEQ ID NO: 6102 - DNA, 50 bp, Homo sapiens
ggaacttctgcttccacttacgatgaaggaacttgtactcaatccatcca

SEQ ID NO: 6103 - DNA, 50 bp, Homo sapiens
gaagccttcctgtggtcataacaagtctcacacaccccaaggactgatct

SEQ ID NO: 6104 - DNA, 50 bp, Homo sapiens
gagtccagcctttgaacctggcgctgaatcctgactttactgcttattca

SEQ ID NO: 6105 - DNA, 50 bp, Homo sapiens
aaactcatacatgcagaaaattgtctttgctcgaaatggtaatgccaaaa

SEQ ID NO: 6106 - DNA, 50 bp, Homo sapiens; identical to SEQ ID NO: 6105

SEQ ID NO: 6107 - DNA, 50 bp, Homo sapiens
acaaaagtcatggctgtgaggctatcattacccttttaccaaagttggaa

SEQ ID NO: 6108 - DNA, 53 bp, Homo sapiens
agttctatttctatcccaaactaagctatgtgaaataagagaagctactttgt

SEQ ID NO: 6109 - DNA, 50 bp, Homo sapiens
atcccgatggtgcccaccgctattaaaggttcgtttgttccacgattaaa

SEQ ID NO: 6110 - DNA, 50 bp, Homo sapiens
atgtctccatacccattacaatctccagcattccccctcaaacctaaaaa

SEQ ID NO: 6111 - DNA, 50 bp, Homo sapiens
gcccgtatttaccctatagcaccccctctaccccctttagagcccaaaaa

SEQ ID NO: 6112 - DNA, 50 bp, Homo sapiens
acattttcctccgcataagcctgcgtcagattaaaacactgaactgacaa

SEQ ID NO: 6113 - DNA, 50 bp, Homo sapiens
ccaagctggtttcaagccaaccccatggcctccatgactttttccaaaac

SEQ ID NO: 6114 - DNA, 50 bp, Homo sapiens
tgatcaggtgaaccggaagtctccaatttctgaatggattatgtttctaa

SEQ ID NO: 6115 - DNA, 50 bp, Homo sapiens
tgagtacgtgacacttgttgtagaatagtggtgttgagctatattcttgt

SEQ ID NO: 6116 - DNA, 50 bp, Homo sapiens
gtgacccttggcacccgctagaagtttatggccgagctttaccaattaaa

SEQ ID NO: 6117 - DNA, 50 bp, Homo sapiens
tgaactccaactttgaccaacccatgagacccctgttatccaaactttct

SEQ ID NO: 6118 - DNA, 50 bp, Homo sapiens
ccctctactatttggctccataacttaggacctgcctttcccggttccag

SEQ ID NO: 6119 - DNA, 50 bp, Homo sapiens
cccgtatttaccctatagcaccccctctaccccctttagagccccaaaaa

SEQ ID NO: 6120 - DNA, 50 bp, Homo sapiens
ccaactttcagaacagaagggtgggaaaccagaaccgcctgccatgcccc

SEQ ID NO: 6121 - DNA, 50 bp, Homo sapiens
gcgccagaaatccaatccagcccaaggatatagttaggattaattactta

SEQ ID NO: 6122 - DNA, 50 bp, Homo sapiens
ctgagattttgggttttccacacgggccaagatacccggcctctgctgag

SEQ ID NO: 6123 - DNA, 50 bp, Homo sapiens
atatcatttccacttagtattatacccacacccacccaagaacagggttt

SEQ ID NO: 6124 - DNA, 50 bp, Homo sapiens
acagcatgagaaactgttagtacgcatacctcagttcaaacctttaggga

SEQ ID NO: 6125 - DNA, 50 bp, Homo sapiens
gcttgccctagcagagtcatacggaataatggaaaactcaacttctgttc

SEQ ID NO: 6126 - DNA, 50 bp, Homo sapiens
cacaatgctgcctcctctgtggatgactgatggcaagagtctgaattgaa

SEQ ID NO: 6127 - DNA, 50 bp, Homo sapiens
cctctcactctcagactccaagggccaagaaaaactacggacaggaagcc

SEQ ID NO: 6128 - DNA, 50 bp, Homo sapiens
gagaggaggggtctcagacgttgggggacacactgctgggtgggtgattt

SEQ ID NO: 6129 - DNA, 50 bp, Homo sapiens
taagaaatcccaattttcaggagtggtggtgtcaataaacgctctgtggc

SEQ ID NO: 6130 - DNA, 50 bp, Homo sapiens
cggcagggtggcctgtaacaatttcagttttcgcagaacattcaggtatt

SEQ ID NO: 6131 - DNA, 50 bp, Homo sapiens
ggggctcccttcccggctttgttttctctgggagattttattttacctaa

SEQ ID NO: 6132 - DNA, 50 bp, Homo sapiens
gaaagtggagggagtggacggggaggagactagccagagaggctcattag

SEQ ID NO: 6133 - DNA, 50 bp, Homo sapiens
cttctcccctcttgccctctgtggtctgatttaaaacgaaaaggtcggat

SEQ ID NO: 6134 - DNA, 50 bp, Homo sapiens
ggacttctgaaatagagctggctccctggggtgacaatgtatatatgcaa

SEQ ID NO: 6135 - DNA, 50 bp, Homo sapiens
ctgggtgtcgtggaagatgacgaagatgctgggctggcagatgcagtcca

SEQ ID NO: 6136 - DNA, 50 bp, Homo sapiens
accagggcttaaaacctcaatttatgttcatgacagtggggatttttctt

SEQ ID NO: 6137 - DNA, 50 bp, Homo sapiens
attctccaaccacaaacagcacttctaaaactaactttactttctgccca

SEQ ID NO: 6138 - DNA, 50 bp, Homo sapiens
gatatagtctccataccccattaccatctcccagccattccccctccaac

SEQ ID NO: 6139 - DNA, 50 bp, Homo sapiens
tgatactttggttctctttcctgctcaggtcccttcatttgtactttgga

SEQ ID NO: 6140 - DNA, 50 bp, Homo sapiens
taatactggaggggcttgaagaaggctgtcgtgttttgtcacctgctttg

SEQ ID NO: 6141 - DNA, 50 bp, Homo sapiens
gtctttcccgtctttcttcctcacctatgtaatttcagtagtctctcagc

SEQ ID NO: 6142 - DNA, 50 bp, Homo sapiens
aggaagagcctgcacctgtggtggaacaatcagggaaaaggaagtcaaaa

SEQ ID NO: 6143 - DNA, 50 bp, Homo sapiens
tttggagcttctataggagtggagaggggcagctcattgttgagagttgc

SEQ ID NO: 6144 - DNA, 50 bp, Homo sapiens
tgatctgactggaaaacaatcctgtatcccctcccaaagaatcatgggct

SEQ ID NO: 6145 - DNA, 50 bp, Homo sapiens
tcatcccttaaacactctgtgatgggatcttcaggatcatcttttgaagt

SEQ ID NO: 6146 - DNA, 50 bp, Homo sapiens
tgcgtttggtttaggaatgtgcttttgtacttccacttgaataaaggtgt

SEQ ID NO: 6147 - DNA, 50 bp, Homo sapiens
tgctcagggcacatgcacacagacatttatctctgcactcacattttgtg

SEQ ID NO: 6148 - DNA, 50 bp, Homo sapiens
ggttattgctgacacgctgtcctctggcgacctgtcgctggagaggttgg

SEQ ID NO: 6149 - DNA, 50 bp, Homo sapiens
cgttttctgagcatccgttgtgccttaacattttctgcttgtcctttggg

SEQ ID NO: 6150 - DNA, 50 bp, Homo sapiens
cttctgaatgcccgagtcttctcttttgtgctcacaaatgccacccaatc

SEQ ID NO: 6151 - DNA, 50 bp, Homo sapiens
tgcttacaagggtgattgaccttgccttactctttatgtaaattatggca

SEQ ID NO: 6152 - DNA, 50 bp, Homo sapiens
ctggcgtattaccattttgatagcctctcttcaggctagataagctgggg

SEQ ID NO: 6153 - DNA, 50 bp, Homo sapiens
ccctgtattattgaaatgtcagcataatgactggaaggtgaaattggtcc

SEQ ID NO: 6154 - DNA, 50 bp, Homo sapiens
actgctgttgcatgaatagatgatacaaagcaagtgatgaggttggtatg

SEQ ID NO: 6155 - DNA, 50 bp, Homo sapiens
tggaagaacaaattcagacatcatcagtaagtctttagggacacagggaa

SEQ ID NO: 6156 - DNA, 50 bp, Homo sapiens
agtgaaaactggtacagtgttctgcttgatttacaacatgtaacttgtga

SEQ ID NO: 6157 - DNA, 50 bp, Homo sapiens
gccagaaagtgtgggctgaagatggttggtttcatgtttttgtattatgt

SEQ ID NO: 6158 - DNA, 50 bp, Homo sapiens
tgtcctctgaacctgagtgaagaaatatactctgtcctttgtacctgcgt

SEQ ID NO: 6159 - DNA, 50 bp, Homo sapiens
ccatttccactacatgcctttcctaccttcccttcacaaccaatcaagtg

SEQ ID NO: 6160 - DNA, 50 bp, Homo sapiens
acacttccctgaatgttgaagaagatatgctatccatgcaatccttgtcg

SEQ ID NO: 6161 - DNA, 50 bp, Homo sapiens
acttgtgtttgaaccacttctgcttcctctttaacctgagatgcacacgt

SEQ ID NO: 6162 - DNA, 50 bp, Homo sapiens; identical to SEQ ID NO: 6062

SEQ ID NO: 6163 - DNA, 50 bp, Homo sapiens
tgacagaatgaactggaaatgaaatcccacagttatgatcgtagtagagt

SEQ ID NO: 6164 - DNA, 50 bp, Homo sapiens
aagtacagatgccatcccggtgctgtgatcttccagccattctccatttc

SEQ ID NO: 6165 - DNA, 50 bp, Homo sapiens
actgccaatctgatttaaaattctccaagcttaattctgtgcaacaaaca

SEQ ID NO: 6166 - DNA, 50 bp, Homo sapiens
gcctgttgttctgtttatcgccctattttacaaaactgattctgacctgg

SEQ ID NO: 6167 - DNA, 50 bp, Homo sapiens
aactggcattgctaagccccagaaaaatgtatttagtggaacagatgaaa

SEQ ID NO: 6168 - DNA, 50 bp, Homo sapiens
acactaggtccttttatacctgtgcctttacgttcgttttcctgattgca

SEQ ID NO: 6169 - DNA, 50 bp, Homo sapiens
aatacagattcattttatttaagcgtccgtggcaccgacagggaccccag

SEQ ID NO: 6170 - DNA, 50 bp, Homo sapiens
agttcatcccctttcagaagctgtttgctcttggctcattaaacctgtga

SEQ ID NO: 6171 - DNA, 50 bp, Homo sapiens
gcctcttttcctgtatcacacaagggtcagggatggtggagtaaaagctc

SEQ ID NO: 6172 - DNA, 50 bp, Homo sapiens
tgttaggtggcctctgcatacctatgggaactcagtgatgtaatgcaaag

SEQ ID NO: 6173 - DNA, 50 bp, Homo sapiens
ctggggccgtagcaaaaatcatgaaaaacacttcaacgtgtcctttcaat

SEQ ID NO: 6174 - DNA, 50 bp, Homo sapiens
tgccaagtcagcagatttgctttatgaattacagggactagaaatgccca

SEQ ID NO: 6175 - DNA, 50 bp, Homo sapiens
ttgcatgtctcttcctaaatttcattgtgttgatttctaatccttcccgt

SEQ ID NO: 6176 - DNA, 50 bp, Homo sapiens; identical to SEQ ID NO: 4273

SEQ ID NO: 6177 - DNA, 50 bp, Homo sapiens
gaagtgacactgactgtatctacctctccttttcttcatcaggtgttcct

SEQ ID NO: 6178 - DNA, 50 bp, Homo sapiens; identical to SEQ ID NO: 5021

SEQ ID NO: 6179 - DNA, 50 bp, Homo sapiens
aattccaaaggagtgatgttggaatagtccctctaagggagagaaatgca

SEQ ID NO: 6180 - DNA, 50 bp, Homo sapiens
agcccctccaccccacccagtacttttacaatgtgttattaaagacccct

SEQ ID NO: 6181 - DNA, 50 bp, Homo sapiens
ccatccttgagaaatgtgggcaccaagtccataatctccataaatccaat

SEQ ID NO: 6182 - DNA, 50 bp, Homo sapiens
cgttgcattttcacatttgtgtggcaggacaagcatggggcaagagggac

SEQ ID NO: 6183 - DNA, 50 bp, Homo sapiens
tatgagtttatgcgttttcccagccctccgaatcactgactggggcgttt

SEQ ID NO: 6184 - DNA, 50 bp, Homo sapiens
ttgaaaagatgacatcgccccaagagccaaaaataaatgggaattgaaaa

SEQ ID NO: 6185 - DNA, 50 bp, Homo sapiens; identical to SEQ ID NO: 4224

SEQ ID NO: 6186 - DNA, 50 bp, Homo sapiens
tggtgatatctgcttagatttccctgtatctttgctgccctccttcaagt

SEQ ID NO: 6187 - DNA, 50 bp, Homo sapiens
agttggagctatctgtgcagcagtttctctacagttgtgcataaatgttt

SEQ ID NO: 6188 - DNA, 50 bp, Homo sapiens
cgtgggaggatgacaaagaagcatgagtcaccctgctggataaacttaga

SEQ ID NO: 6189 - DNA, 50 bp, Homo sapiens
gtggtttggtcagcatacacacttctcatttcatttgatgtacacagcca

SEQ ID NO: 6190 - DNA, 50 bp, Homo sapiens
acctgggatttcatttctgctgaaagaaataggaagaacaggactcactt

SEQ ID NO: 6191 - DNA, 50 bp, Homo sapiens
gggtgtgatgaatagcgaatcatctcaaatccttgagcactcagtctagt

SEQ ID NO: 6192 - DNA, 50 bp, Homo sapiens
agctttcaccacctcgcagttgtagagatagtccccgaaatattattcca

SEQ ID NO: 6193 - DNA, 50 bp, Homo sapiens
gtgtgaagtgacagccttgtgtgtgatgttttctgccttccccaagtttg

SEQ ID NO: 6194 - DNA, 51 bp, Homo sapiens; identical to SEQ ID NO: 5427

SEQ ID NO: 6195 - DNA, 50 bp, Homo sapiens
taagtggattggcagactccttgttgcttaagagtggctttctaggcagg

SEQ ID NO: 6196 - DNA, 51 bp, Homo sapiens; identical to SEQ ID NO: 5427

SEQ ID NO: 6197 - DNA, 50 bp, Homo sapiens; identical to SEQ ID NO: 5944

SEQ ID NO: 6198 - DNA, 50 bp, Homo sapiens; identical to SEQ ID NO: 6141

SEQ ID NO: 6199 - DNA, 50 bp, Homo sapiens
ggtccactctcactctttctctgctgttgcaaatacatggataacaccgt

SEQ ID NO: 6200 - DNA, 50 bp, Homo sapiens
cattcagtatttattgggaagacttgtcaagcaccatgataagtggtgga

SEQ ID NO: 6201 - DNA, 50 bp, Homo sapiens
agagggggaaggacttacatgacatcctactgggaatttgctagaaacca

SEQ ID NO: 6202 - DNA, 50 bp, Homo sapiens
ctggtgaagctgactccccaggtaaagagatatcagctctgcttcagact

SEQ ID NO: 6203 - DNA, 50 bp, Homo sapiens
ttgcttcttcctgctttatagagttcccgtaaaatacccttcaccctggc

SEQ ID NO: 6204 - DNA, 51 bp, Homo sapiens
tctgacctccgtgacgtttattaccagctgatgtcccgtacactgatttca

SEQ ID NO: 6205 - DNA, 50 bp, Homo sapiens
gggaagggtcagcaacgatttctcaccaaatcactacacagacacaaagg

SEQ ID NO: 6206 - DNA, 50 bp, Homo sapiens
accactaaatggttacactacaccaagacactaaaatggcagggagccct

SEQ ID NO: 6207 - DNA, 50 bp, Homo sapiens
aaattcaaatcacccttgatacccacttctttctcccacccaaatctgat

SEQ ID NO: 6208 - DNA, 51 bp, Homo sapiens
accatatcgtgcaaaatgtaatatggaatttccaaacatcaatgaagggat

SEQ ID NO: 6209 - DNA, 50 bp, Homo sapiens
aataagtaccgtatataaacacttctctttctctcctccacaatggcacg

SEQ ID NO: 6210 - DNA, 50 bp, Homo sapiens
agcatcactcttagaagaagcaactccttcccttgattctgtgtatttgg

SEQ ID NO: 6211 - DNA, 53 bp, Homo sapiens
tcaacccagaatctataatgtatgaaataaattaatagagaacccaacagatc

SEQ ID NO: 6212 - DNA, 50 bp, Homo sapiens
aaggtctccatctaacaggtagagcagttggtgcagatgagatgagcctg

SEQ ID NO: 6213 - DNA, 50 bp, Homo sapiens
ggtgatgataccacctccaatgaacagggaagcaagttcatcagtcaaca

SEQ ID NO: 6214 - DNA, 50 bp, Homo sapiens
agctgttggggctgcactgagctgcaatttttaacatggatttataactt

SEQ ID NO: 6215 - DNA, 50 bp, Homo sapiens
aaggaatttgttttccctatcctaactcagtaacagagggtttactccga

SEQ ID NO: 6216 - DNA, 50 bp, Homo sapiens
cgcacacattttctgtatggacaaatcctggattggcttcgttatttggt

SEQ ID NO: 6217 - DNA, 50 bp, Homo sapiens
ggtaatgaaacaatcatccagttaacaatcagcaaggttcttcagagcct

SEQ ID NO: 6218 - DNA, 51 bp, Homo sapiens
tggaagagtggactgaagaaagaacttatactctccctcctctaaaattga

SEQ ID NO: 6219 - DNA, 50 bp, Homo sapiens
tcctgggctattggctttatgatatcttttgagaaacaggattttcactt

SEQ ID NO: 6220 - DNA, 50 bp, Homo sapiens
accttttaaggatgtcttatttccaccccaactctccactccattttagt

SEQ ID NO: 6221 - DNA, 50 bp, Homo sapiens
gaaccttcaaaactgtcactttgagttccagaagagtccttcagcatctt

SEQ ID NO: 6222 - DNA, 50 bp, Homo sapiens
gtatttgggcttctccaagcagatcacgcagacgacggtgctacatttga

SEQ ID NO: 6223 - DNA, 50 bp, Homo sapiens
caagcatactggttctttccaagctcactgttctcaccacacggccccac

SEQ ID NO: 6224 - DNA, 50 bp, Homo sapiens
tccatatccatttctgacgttgaaccatttgacagtgccaaggactttgg

SEQ ID NO: 6225 - DNA, 50 bp, Homo sapiens
aagcctgtttttcactctaaaaattcaagaggacacgctaagaacgatca

SEQ ID NO: 6226 - DNA, 50 bp, Homo sapiens; identical to SEQ ID NO: 4276

SEQ ID NO: 6227 - DNA, 50 bp, Homo sapiens
gcgcacatggctattttgatacacaaagttgtgtttgctactttagaagc

SEQ ID NO: 6228 - DNA, 50 bp, Homo sapiens
aactcacgacaattgctacaaaacaccagggaggggctttttgtgttttt

SEQ ID NO: 6229 - DNA, 50 bp, Homo sapiens; identical to SEQ ID NO: 6141

SEQ ID NO: 6230 - DNA, 50 bp, Homo sapiens
gccctggtatgtatgcctttctctcctactgtctaatagcacctcgtaaa

SEQ ID NO: 6231 - DNA, 50 bp, Homo sapiens
aagaaaccgtggaagatactggtttatttcaaatgagcagagtatgttgt

SEQ ID NO: 6232 - DNA, 50 bp, Homo sapiens
ccacctcttctgacatgaatgtagcataagttagcaatcggttcttccaa

SEQ ID NO: 6233 - DNA, 50 bp, Homo sapiens
aggttccctttcaaataaagataaagaatttgacttgggacactgccaga

SEQ ID NO: 6234 - DNA, 50 bp, Homo sapiens
ggctggcctcattttgaaaagttagtacaattttcttcagtgctaacttg

SEQ ID NO: 6235 - DNA, 50 bp, Homo sapiens
actccagaacgtcagaaatggtgtagcagaatgaattctgttataaggaa

SEQ ID NO: 6236 - DNA, 50 bp, Homo sapiens
ctgttcgaaagttggagactgcctgtacccaggttgatagtcaattgttt

SEQ ID NO: 6237 - DNA, 50 bp, Homo sapiens
ccaccttgagcgccttcttctggttggttgtcatgcagttctcacacatg

SEQ ID NO: 6238 - DNA, 50 bp, Homo sapiens
acccttcccctttttcatatcctttcttcaaaaatctaaatgatgtgcct

SEQ ID NO: 6239 - DNA, 50 bp, Homo sapiens
agttccaggaggtggttttaaatattggatgaaaacttacaggctgtttt

SEQ ID NO: 6240 - DNA, 50 bp, Homo sapiens
acaatacatttacaaagccatctttacatgcattaaacgagggctacaac

SEQ ID NO: 6241 - DNA, 50 bp, Homo sapiens; identical to SEQ ID NO: 6240

SEQ ID NO: 6242 - DNA, 50 bp, Homo sapiens
ggcctgaagaaggagataagtgttccattcggcaacataagagaagttaa

SEQ ID NO: 6243 - DNA, 50 bp, Homo sapiens
tccatcccaaaggagagctactgtactgactgtacttgtggaatgcagcg

SEQ ID NO: 6244 - DNA, 50 bp, Homo sapiens
acccaccactctcaggaccacctgaaggcagaataaaccggatcctgttg

SEQ ID NO: 6245 - DNA, 50 bp, Homo sapiens
aaattgtgtgagaaggctgataaacgtctgtggtttctccctgtgctatt

SEQ ID NO: 6246 - DNA, 51 bp, Homo sapiens
gctgggcttctgcaaaattataaagttgctttattaaattcatacatgcgg

SEQ ID NO: 6247 - DNA, 51 bp, Homo sapiens
agctgattcattcattctatgtgtgccactaaataaagagattgagcaagt

SEQ ID NO: 6248 - DNA, 50 bp, Homo sapiens
cttgaagctgtgttggtggcctgtgaccttccaatgcaatctagactgtg

SEQ ID NO: 6249 - DNA, 50 bp, Homo sapiens
ctcatacacttctcagcctcagcacctaaccctcacacaacactccagta

SEQ ID NO: 6250 - DNA, 50 bp, Homo sapiens
tgagtattgttgtgggggcgggtatgtctgtatataaatctgtgcagcca

SEQ ID NO: 6251 - DNA, 50 bp, Homo sapiens; identical to SEQ ID NO: 4263

SEQ ID NO: 6252 - DNA, 50 bp, Homo sapiens; identical to SEQ ID NO: 4347

SEQ ID NO: 6253 - DNA, 50 bp, Homo sapiens; identical to SEQ ID NO: 4226

SEQ ID NO: 6254 - DNA, 50 bp, Homo sapiens; identical to SEQ ID NO: 4353

SEQ ID NO: 6255 - DNA, 50 bp, Homo sapiens
aggttgttatcaggtggcacaaattaaatccatcttgaagacttcacaca

SEQ ID NO: 6256 - DNA, 50 bp, Homo sapiens; identical to SEQ ID NO: 5073

SEQ ID NO: 6257 - DNA, 50 bp, Homo sapiens
agagctatgggtgctacaggcttgtctttctaagtgacatattcttatct

SEQ ID NO: 6258 - DNA, 50 bp, Homo sapiens
acccttataaaccagagcccaggaaagacagctcgagtgtataattctct

SEQ ID NO: 6259 - DNA, 50 bp, Homo sapiens
agctcctccctctcaacacccagtttccttgggagttgtcattaaaggaa

SEQ ID NO: 6260 - DNA, 50 bp, Homo sapiens
gctgtaattctctgtctcatcatccttctcttttgtttccatagcctttt

SEQ ID NO: 6261 - DNA, 50 bp, Homo sapiens; identical to SEQ ID NO: 4227

SEQ ID NO: 6262 - DNA, 50 bp, Homo sapiens; identical to SEQ ID NO: 4306

SEQ ID NO: 6263 - DNA, 50 bp, Homo sapiens; identical to SEQ ID NO: 4322

SEQ ID NO: 6264 - DNA, 50 bp, Homo sapiens; identical to SEQ ID NO: 4208

SEQ ID NO: 6265 - DNA, 50 bp, Homo sapiens
agaggcaacacttaaacactagggctactgtggcatctatgtagacagga

SEQ ID NO: 6266 - DNA, 50 bp, Homo sapiens; identical to SEQ ID NO: 4296

SEQ ID NO: 6267 - DNA, 50 bp, Homo sapiens; identical to SEQ ID NO: 4274

SEQ ID NO: 6268 - DNA, 50 bp, Homo sapiens; identical to SEQ ID NO: 4273

SEQ ID NO: 6269 - DNA, 50 bp, Homo sapiens; identical to SEQ ID NO: 4250

SEQ ID NO: 6270 - DNA, 50 bp, Homo sapiens; identical to SEQ ID NO: 238

SEQ ID NO: 6271 - DNA, 50 bp, Homo sapiens; identical to SEQ ID NO: 4305

SEQ ID NO: 6272 - DNA, 50 bp, Homo sapiens
acttcccctttaggtatccctggagtaataatgacaacaaaattcactgc

SEQ ID NO: 6273 - DNA, 50 bp, Homo sapiens; identical to SEQ ID NO: 4205

SEQ ID NO: 6274 - DNA, 50 bp, Homo sapiens; identical to SEQ ID NO: 5148

SEQ ID NO: 6275 - DNA, 50 bp, Homo sapiens; identical to SEQ ID NO: 5170

SEQ ID NO: 6276 - DNA, 50 bp, Homo sapiens; identical to SEQ ID NO: 5189

SEQ ID NO: 6277 - DNA, 50 bp, Homo sapiens; identical to SEQ ID NO: 5215

SEQ ID NO: 6278 - DNA, 50 bp, Homo sapiens; identical to SEQ ID NO: 5262

SEQ ID NO: 6279 - DNA, 50 bp, Homo sapiens; identical to SEQ ID NO: 5269

SEQ ID NO: 6280 - DNA, 50 bp, Homo sapiens; identical to SEQ ID NO: 5328

SEQ ID NO: 6281 - DNA, 50 bp, Homo sapiens; identical to SEQ ID NO: 5341

SEQ ID NO: 6282 - DNA, 51 bp, Homo sapiens
gcaactgttttctaggacatgtttactagaactactttaagtatgctgtgc

SEQ ID NO: 6283 - DNA, 50 bp, Homo sapiens; identical to SEQ ID NO: 5350

SEQ ID NO: 6284 - DNA, 50 bp, Homo sapiens; identical to SEQ ID NO: 5357

SEQ ID NO: 6285 - DNA, 50 bp, Homo sapiens; identical to SEQ ID NO: 5359

SEQ ID NO: 6286 - DNA, 50 bp, Homo sapiens; identical to SEQ ID NO: 5363

SEQ ID NO: 6287 - DNA, 50 bp, Homo sapiens; identical to SEQ ID NO: 5366

SEQ ID NO: 6288 - DNA, 50 bp, Homo sapiens; identical to SEQ ID NO: 5368

SEQ ID NO: 6289 - DNA, 50 bp, Homo sapiens; identical to SEQ ID NO: 5379

SEQ ID NO: 6290 - DNA, 50 bp, Homo sapiens; identical to SEQ ID NO: 5388

SEQ ID NO: 6291 - DNA, 50 bp, Homo sapiens; identical to SEQ ID NO: 5422

SEQ ID NO: 6292 - DNA, 50 bp, Homo sapiens; identical to SEQ ID NO: 5446

SEQ ID NO: 6293 - DNA, 50 bp, Homo sapiens; identical to SEQ ID NO: 5447

SEQ ID NO: 6294 - DNA, 50 bp, Homo sapiens; identical to SEQ ID NO: 5454

SEQ ID NO: 6295 - DNA, 50 bp, Homo sapiens; identical to SEQ ID NO: 5494

SEQ ID NO: 6296 - DNA, 50 bp, Homo sapiens; identical to SEQ ID NO: 5496

SEQ ID NO: 6297 - DNA, 50 bp, Homo sapiens; identical to SEQ ID NO: 5501

SEQ ID NO: 6298 - DNA, 50 bp, Homo sapiens; identical to SEQ ID NO: 5508

SEQ ID NO: 6299 - DNA, 50 bp, Homo sapiens; identical to SEQ ID NO: 5517

SEQ ID NO: 6300 - DNA, 50 bp, Homo sapiens; identical to SEQ ID NO: 5519

SEQ ID NO: 6301 - DNA, 50 bp, Homo sapiens; identical to SEQ ID NO: 5522

SEQ ID NO: 6302 - DNA, 50 bp, Homo sapiens; identical to SEQ ID NO: 5525

SEQ ID NO: 6303 - DNA, 50 bp, Homo sapiens; identical to SEQ ID NO: 5527

SEQ ID NO: 6304 - DNA, 50 bp, Homo sapiens; identical to SEQ ID NO: 5540

SEQ ID NO: 6305 - DNA, 50 bp, Homo sapiens; identical to SEQ ID NO: 5542

SEQ ID NO: 6306 - DNA, 50 bp, Homo sapiens; identical to SEQ ID NO: 5543

SEQ ID NO: 6307 - DNA, 50 bp, Homo sapiens; identical to SEQ ID NO: 5552

SEQ ID NO: 6308 - DNA, 50 bp, Homo sapiens; identical to SEQ ID NO: 5559

SEQ ID NO: 6309 - DNA, 50 bp, Homo sapiens; identical to SEQ ID NO: 5571

SEQ ID NO: 6310 - DNA, 50 bp, Homo sapiens; identical to SEQ ID NO: 5682

SEQ ID NO: 6311 - DNA, 50 bp, Homo sapiens; identical to SEQ ID NO: 5712

SEQ ID NO: 6312 - DNA, 50 bp, Homo sapiens; identical to SEQ ID NO: 5714

SEQ ID NO: 6313 - DNA, 50 bp, Homo sapiens; identical to SEQ ID NO: 5723

SEQ ID NO: 6314 - DNA, 50 bp, Homo sapiens; identical to SEQ ID NO: 5725

SEQ ID NO: 6315 - DNA, 50 bp, Homo sapiens; identical to SEQ ID NO: 5775

SEQ ID NO: 6316 - DNA, 50 bp, Homo sapiens; identical to SEQ ID NO: 5938

SEQ ID NO: 6317 - DNA, 50 bp, Homo sapiens; identical to SEQ ID NO: 5944

SEQ ID NO: 6318 - DNA, 50 bp, Homo sapiens; identical to SEQ ID NO: 5953

SEQ ID NO: 6319 - DNA, 50 bp, Homo sapiens; identical to SEQ ID NO: 5954

SEQ ID NO: 6320 - DNA, 50 bp, Homo sapiens; identical to SEQ ID NO: 5959

SEQ ID NO: 6321 - DNA, 50 bp, Homo sapiens; identical to SEQ ID NO: 5961

SEQ ID NO: 6322 - DNA, 50 bp, Homo sapiens; identical to SEQ ID NO: 6002

SEQ ID NO: 6323 - DNA, 50 bp, Homo sapiens; identical to SEQ ID NO: 6010

SEQ ID NO: 6324 - DNA, 50 bp, Homo sapiens
tggcataatgttggattgaatctacattttggcagaagttaaacattccc

SEQ ID NO: 6325 - DNA, 50 bp, Homo sapiens; identical to SEQ ID NO: 6014

SEQ ID NO: 6326 - DNA, 50 bp, Homo sapiens; identical to SEQ ID NO: 6019

SEQ ID NO: 6327 - DNA, 50 bp, Homo sapiens; identical to SEQ ID NO: 6023

SEQ ID NO: 6328 - DNA, 50 bp, Homo sapiens; identical to SEQ ID NO: 6027

SEQ ID NO: 6329 - DNA, 50 bp, Homo sapiens; identical to SEQ ID NO: 6031

SEQ ID NO: 6330 - DNA, 50 bp, Homo sapiens; identical to SEQ ID NO: 6032

SEQ ID NO: 6331 - DNA, 50 bp, Homo sapiens; identical to SEQ ID NO: 4348

SEQ ID NO: 6332 - DNA, 50 bp, Homo sapiens; identical to SEQ ID NO: 6037

SEQ ID NO: 6333 - DNA, 50 bp, Homo sapiens; identical to SEQ ID NO: 6039

SEQ ID NO: 6334 - DNA, 50 bp, Homo sapiens; identical to SEQ ID NO: 6041

SEQ ID NO: 6335 - DNA, 50 bp, Homo sapiens; identical to SEQ ID NO: 6042

SEQ ID NO: 6336 - DNA, 50 bp, Homo sapiens; identical to SEQ ID NO: 6044

SEQ ID NO: 6337 - DNA, 50 bp, Homo sapiens; identical to SEQ ID NO: 6047

SEQ ID NO: 6338 - DNA, 50 bp, Homo sapiens; identical to SEQ ID NO: 6051

SEQ ID NO: 6339 - DNA, 50 bp, Homo sapiens; identical to SEQ ID NO: 6065

SEQ ID NO: 6340 - DNA, 50 bp, Homo sapiens; identical to SEQ ID NO: 6088

SEQ ID NO: 6341 - DNA, 50 bp, Homo sapiens; identical to SEQ ID NO: 6124

SEQ ID NO: 6342 - DNA, 50 bp, Homo sapiens; identical to SEQ ID NO: 6126

SEQ ID NO: 6343 - DNA, 50 bp, Homo sapiens; identical to SEQ ID NO: 6129

SEQ ID NO: 6344 - DNA, 50 bp, Homo sapiens; identical to SEQ ID NO: 6130

SEQ ID NO: 6345 - DNA, 50 bp, Homo sapiens
gctggagggagaggcactggggaatttttcctggtgaatactgaagttac

SEQ ID NO: 6346 - DNA, 50 bp, Homo sapiens; identical to SEQ ID NO: 6139

SEQ ID NO: 6347 - DNA, 50 bp, Homo sapiens
actgccagtgaagactgtaaagacagaacacactattttggagggaggat

SEQ ID NO: 6348 - DNA, 50 bp, Homo sapiens; identical to SEQ ID NO: 6142

SEQ ID NO: 6349 - DNA, 50 bp, Homo sapiens; identical to SEQ ID NO: 6143

SEQ ID NO: 6350 - DNA, 50 bp, Homo sapiens; identical to SEQ ID NO: 6144

SEQ ID NO: 6351 - DNA, 50 bp, Homo sapiens; identical to SEQ ID NO: 6149

SEQ ID NO: 6352 - DNA, 50 bp, Homo sapiens; identical to SEQ ID NO: 6154

SEQ ID NO: 6353 - DNA, 50 bp, Homo sapiens; identical to SEQ ID NO: 6156

SEQ ID NO: 6354 - DNA, 50 bp, Homo sapiens; identical to SEQ ID NO: 6158

SEQ ID NO: 6355 - DNA, 50 bp, Homo sapiens; identical to SEQ ID NO: 6159

SEQ ID NO: 6356 - DNA, 50 bp, Homo sapiens; identical to SEQ ID NO: 6169

SEQ ID NO: 6357 - DNA, 50 bp, Homo sapiens; identical to SEQ ID NO: 6171

SEQ ID NO: 6358 - DNA, 50 bp, Homo sapiens; identical to SEQ ID NO: 6173

SEQ ID NO: 6359 - DNA, 50 bp, Homo sapiens; identical to SEQ ID NO: 5309

SEQ ID NO: 6360 - DNA, 50 bp, Homo sapiens
aaggcaaccaaccacattagaagtcttggcactttgtaacggaacgggta

SEQ ID NO: 6361 - DNA, 50 bp, Homo sapiens; identical to SEQ ID NO: 6177

SEQ ID NO: 6362 - DNA, 50 bp, Homo sapiens; identical to SEQ ID NO: 6179

SEQ ID NO: 6363 - DNA, 50 bp, Homo sapiens; identical to SEQ ID NO: 6180

SEQ ID NO: 6364 - DNA, 50 bp, Homo sapiens; identical to SEQ ID NO: 6181

SEQ ID NO: 6365 - DNA, 50 bp, Homo sapiens; identical to SEQ ID NO: 6183

SEQ ID NO: 6366 - DNA, 50 bp, Homo sapiens; identical to SEQ ID NO: 6187

SEQ ID NO: 6367 - DNA, 50 bp, Homo sapiens; identical to SEQ ID NO: 6188

SEQ ID NO: 6368 - DNA, 50 bp, Homo sapiens; identical to SEQ ID NO: 6189

SEQ ID NO: 6369 - DNA, 50 bp, Homo sapiens; identical to SEQ ID NO: 6193

SEQ ID NO: 6370 - DNA, 50 bp, Homo sapiens; identical to SEQ ID NO: 6141

SEQ ID NO: 6371 - DNA, 50 bp, Homo sapiens; identical to SEQ ID NO: 1043

SEQ ID NO: 6372 - DNA, 50 bp, Homo sapiens
gtggaaatcagcacacaaccacaatgacatttaagcacaggatcattatt

SEQ ID NO: 6373 - DNA, 50 bp, Homo sapiens
agaatggcagacctgtttgctgaagtgttcataagataacaataggcttg

SEQ ID NO: 6374 - DNA, 50 bp, Homo sapiens
tgggattttgtttttaagtcatttggtttggggaggaccttgtttatttt

SEQ ID NO: 6375 - DNA, 50 bp, Homo sapiens
tggacaaactgacagggactgctttgaaagacaggtactcagttgagtat

SEQ ID NO: 6376 - DNA, 50 bp, Homo sapiens; identical to SEQ ID NO: 6225

SEQ ID NO: 6377 - DNA, 50 bp, Homo sapiens; identical to SEQ ID NO: 6233

SEQ ID NO: 6378 - DNA, 50 bp, Homo sapiens; identical to SEQ ID NO: 6236

SEQ ID NO: 6379 - DNA, 50 bp, Homo sapiens
agcagagttaagtttaaatttccattctcactagtttgtgacctttgcca

SEQ ID NO: 6380 - DNA, 50 bp, Homo sapiens; identical to SEQ ID NO: 6250

SEQ ID NO: 6381 - DNA, 50 bp, Homo sapiens
cccttgcagatacatgagacaggcaggggctggagtcttgttccatcctg

SEQ ID NO: 6382 - DNA, 50 bp, Homo sapiens
gagtagttgtctttcctggcactaacgttgagctcgtgtacgcactgaag

SEQ ID NO: 6383 - DNA, 50 bp, Homo sapiens
gagtccaatctacactctagtagtgaagacagaagagttggcatacgagt

SEQ ID NO: 6384 - DNA, 50 bp, Homo sapiens
ggctgaacttactcattaagccacataacttcgagtcaagttccagtcca

SEQ ID NO: 6385 - DNA, 50 bp, Homo sapiens
gctctcaagcctcctccaataaagctctatcgggaaacaaatgaaccagt

SEQ ID NO: 6386 - DNA, 50 bp, Homo sapiens
aggaatgcacacattgctccaggatcactgtgaggattaaaggagatggt

SEQ ID NO: 6387 - DNA, 50 bp, Homo sapiens
agtaacggaacagttcccagtactcctggttcctaggtgagcaggtgatg

SEQ ID NO: 6388 - DNA, 50 bp, Homo sapiens
ggtgtgaaccatgagaagttcgacaacagcctcaagatcatcagcaatga

SEQ ID NO: 6389 - DNA, 50 bp, Homo sapiens
ggaggtgtataggctgggatttgaaaaggaaaataatcagcgtggtgcca

SEQ ID NO: 6390 - DNA, 50 bp, Homo sapiens; identical to SEQ ID NO: 326

SEQ ID NO: 6391 - DNA, 50 bp, Homo sapiens
tccagcagatataggaagcagtgtatctaaacagacaaataaaaaggcct

SEQ ID NO: 6392 - DNA, 50 bp, Homo sapiens
atctagtgtacgagacttggagtcaggcagtgagactggtggggcacggg

SEQ ID NO: 6393 - DNA, 50 bp, Homo sapiens
tggtttaatggaaaatgctctggaaaattcttttgcaacagttcatcgct

SEQ ID NO: 6394 - DNA, 50 bp, Homo sapiens
cactaaaagagtggggaggtgcagcacctggctggggaacaagaatatgg

SEQ ID NO: 6395 - DNA, 50 bp, Homo sapiens
aaacgaatcacgtgcctcgaaagggacatatattgttcctttaagcattt

SEQ ID NO: 6396 - DNA, 50 bp, Homo sapiens
aagggttcaatttcttctttggaaggtgatggtaagggtgtggctccaga

SEQ ID NO: 6397 - DNA, 50 bp, Homo sapiens
tggacaattccaagtccaagaggactgtctactttcgaccttgtgtgatt

SEQ ID NO: 6398 - DNA, 50 bp, Homo sapiens
ttgtgttaacctgttgtccacgctaagatacaaacttcccggaggaaagt

SEQ ID NO: 6399 - DNA, 50 bp, Homo sapiens
tgtcacagtgttctattatttgcccggttcttaaagtgagagcatcctga

SEQ ID NO: 6400 - DNA, 50 bp, Homo sapiens
acaatgatattgatgaggcacccagtcttttcatttactctgagtgaagt

SEQ ID NO: 6401 - DNA, 50 bp, Homo sapiens; identical to SEQ ID NO: 3230

SEQ ID NO: 6402 - DNA, 50 bp, Homo sapiens
ggccagagaccctaagctgcttaatacatttataccacatccttctcagc

SEQ ID NO: 6403 - DNA, 50 bp, Homo sapiens
cccttggaattacttgttcaacttctttctttcccactagacggggactt

SEQ ID NO: 6404 - DNA, 50 bp, Homo sapiens
ctttgtagatgcagagagaagctataagaaaccccagtacttgccgggcg

SEQ ID NO: 6405 - DNA, 54 bp, Homo sapiens
actgccacatctgactttacagaataaccaatgtaagttaaaatagagaaacag

SEQ ID NO: 6406 - DNA, 50 bp, Homo sapiens
agtcttgcgagtcaactcagactcaaatgtagaactgggaaggacagtgc

SEQ ID NO: 6407 - DNA, 50 bp, Homo sapiens
agcactgtgcagatggctttagaagattcagaacagaagcacaatctgtt

SEQ ID NO: 6408 - DNA, 50 bp, Homo sapiens
agcactgtgcagatggctttggaagattcagaacagaagcacaatctgtt

SEQ ID NO: 6409 - DNA, 50 bp, Homo sapiens
ctatggagtcttggaggacactggagtcaccatgctaacactgtgcagat

SEQ ID NO: 6410 - DNA, 50 bp, Homo sapiens
ccctgtcacccttcgtggccagtgccagacagtaactagtggatgctaaa

SEQ ID NO: 6411 - DNA, 50 bp, Homo sapiens
gagagaatagggtagagagaccgggacttgggtagagatgaccgggattc

SEQ ID NO: 6412 - DNA, 50 bp, Homo sapiens
agtggaagctaggagaaatatcgaatgtgttagggactttgaagttacca

SEQ ID NO: 6413 - DNA, 50 bp, Homo sapiens
ctgcatctctctttactaccagtgattacaaagtggggtttggtgggagt

SEQ ID NO: 6414 - DNA, 50 bp, Homo sapiens
tctctgacttcttattaccaaggacactctatctgttgcctcttactctt

SEQ ID NO: 6415 - DNA, 50 bp, Homo sapiens
cagttcccagatgtgcgtgttgtggtccccaagtatcaccttccaatttc

SEQ ID NO: 6416 - DNA, 50 bp, Homo sapiens
aacgaccctgtattgcagaagattgtagacattctgtatgccacagatga

SEQ ID NO: 6417 - DNA, 50 bp, Homo sapiens
gggtcccgagcccttcaagagctagatttactcaagtttgttcccttgcc

SEQ ID NO: 6418 - DNA, 50 bp, Homo sapiens
cactgaagccaaaccacagaagacttttgagaatgaggagacaaatgagt

SEQ ID NO: 6419 - DNA, 50 bp, Homo sapiens
aggtgaaaattactcttcagaagatagcagagtggataatggcccatcga

SEQ ID NO: 6420 - DNA, 50 bp, Homo sapiens
tgcagtgagactacatttctgtctaaagaagatgtgtgagttccgtcctt

SEQ ID NO: 6421 - DNA, 50 bp, Homo sapiens
tccagccagccagctcatttcactttacaccctcatggactgggattata

SEQ ID NO: 6422 - DNA, 50 bp, Homo sapiens
tttcatacattggaactccacctgactttggaccaaccccagaacagagc

SEQ ID NO: 6423 - DNA, 50 bp, Homo sapiens
agcaccggaatacaaaaatgatactatgctgccctcctagatctcaggga

SEQ ID NO: 6424 - DNA, 50 bp, Homo sapiens
tgcccatacacatgagtatttgtctaaaacatgtcttctttgtagcagct

SEQ ID NO: 6425 - DNA, 50 bp, Homo sapiens
gcaaatctaaactgcaggaaaatttttgcacccgaagtattcagatccct

SEQ ID NO: 6426 - DNA, 50 bp, Homo sapiens
ggcccagtgctaatgtaaccaatgatgccatgtcgatattggaaaccata

SEQ ID NO: 6427 - DNA, 50 bp, Homo sapiens
ggggaagaacaagataatctagtgacctcaccacagtctatgcccaggcc

SEQ ID NO: 6428 - DNA, 50 bp, Homo sapiens
aattcaactgaaggcgaggaatgttggtgatgaagctgagatcaggactc

SEQ ID NO: 6429 - DNA, 50 bp, Homo sapiens
cacctatatcgaaagtttgggctcatctcccattggtggcaaagacctcc

SEQ ID NO: 6430 - DNA, 50 bp, Homo sapiens
tggtggaaaagtgtgtctgtctgacaattacactcaagtttacctctggt

SEQ ID NO: 6431 - DNA, 53 bp, Homo sapiens
acgataatactgttggttactgccataaatattggaagctaatgtaaaatgca

SEQ ID NO: 6432 - DNA, 50 bp, Homo sapiens
ttctcttataaaggacagcaagtttaaaatggagcaaggagcattggaaa

SEQ ID NO: 6433 - DNA, 50 bp, Homo sapiens
tggccaaagaatagaagctctagaccttccttatttctatcgtgaaaaca

SEQ ID NO: 6434 - DNA, 50 bp, Homo sapiens
acatgacctgtgcagtgtgtggctgtgaattctgttggctttgtatgaaa

SEQ ID NO: 6435 - DNA, 50 bp, Homo sapiens
tgacataactaccatccctgcaactaatgaacccaccctcacagcttcct

SEQ ID NO: 6436 - DNA, 50 bp, Homo sapiens
gaatgacataaaccccctccggtctgaggtccggccttccagcttgtctc

SEQ ID NO: 6437 - DNA, 50 bp, Homo sapiens
gcctttctcactccatccccacccaaagtgctcagaccttgtctagttat

SEQ ID NO: 6438 - DNA, 50 bp, Homo sapiens
tcgttttacaacgtcgtgactgggaaaaccctggcgttacccaacttaat

SEQ ID NO: 6439 - DNA, 50 bp, Homo sapiens
tgttttgttttctgaaacgaaatcctgctctgttggcccagctagaacgc

SEQ ID NO: 6440 - DNA, 50 bp, Homo sapiens
cagaagctggatgacgttgctccatcttcactctgttaatgagacatgat

SEQ ID NO: 6441 - DNA, 50 bp, Homo sapiens
cacatcttccattcagccctaccatgaaaaccgtacctcgggcgcgacca

SEQ ID NO: 6442 - DNA, 50 bp, Homo sapiens
aatttgctttaaattgagtttccttgccattgcacactcctatctttctg

SEQ ID NO: 6443 - DNA, 50 bp, Homo sapiens
cagatgacacgcgctctccaccacccaacccaaaccatgagaatttgcaa

SEQ ID NO: 6444 - DNA, 50 bp, Homo sapiens
cccatgctgttgattgctaaatgtaacagtctgatcgtgacgctgaataa

SEQ ID NO: 6445 - DNA, 50 bp, Homo sapiens
gacacagacagaccaagctatagtcagacctggttacacacatacacaca

SEQ ID NO: 6446 - DNA, 50 bp, Homo sapiens
tggcaaagatcactgaaatttaggacaccaaagctaaaaccccaaatgct

SEQ ID NO: 6447 - DNA, 50 bp, Homo sapiens
gcttgtgctcgagaccgcttgctatagaaacgctgagctgctggtttatg

SEQ ID NO: 6448 - DNA, 50 bp, Homo sapiens
ctggttaaaagccccattactgaccttcgccgccaccacgcctatcacta

SEQ ID NO: 6449 - DNA, 50 bp, Homo sapiens
gcatccacctccttctctgtctcatgtgtgctcttcttctttctacagta

SEQ ID NO: 6450 - DNA, 50 bp, Homo sapiens
ttaaatctatcaagaattcatccaaattggtaccctgccgggccgcctcg

SEQ ID NO: 6451 - DNA, 50 bp, Homo sapiens
agtgctgtattgactttgctcggcagtagatgaagctattctgaacccaa

SEQ ID NO: 6452 - DNA, 50 bp, Homo sapiens
tgctggacaaagacaatgagatgattattggtggtgggatggctgttacc

SEQ ID NO: 6453 - DNA, 50 bp, Homo sapiens
gtggaaaagtcactaccaggctggcagggaatggggcaatctattcatac

SEQ ID NO: 6454 - DNA, 50 bp, Homo sapiens
aagggacagggagcgggcacaaaataaaacttagtttggtagaaattata

SEQ ID NO: 6455 - DNA, 50 bp, Homo sapiens
tcaaagcactggagatgagagccaggatggacccgaaaagaattttacag

SEQ ID NO: 6456 - DNA, 56 bp, Homo sapiens
caggaacatggctgcagcatataaaaagaattgaattccatacttttgttaaccct

SEQ ID NO: 6457 - DNA, 50 bp, Homo sapiens
ttgccataaccacgcttgtagattagttcatttactgacttcagattggg

SEQ ID NO: 6458 - DNA, 50 bp, Homo sapiens
ttacaggcaaccggagcatccaatcacctttctctaagagagtacctcgg

SEQ ID NO: 6459 - DNA, 50 bp, Homo sapiens
aaaagcatcttcgagagggactgtcaattctcgactattttccaacccgc

SEQ ID NO: 6460 - DNA, 50 bp, Homo sapiens; identical to SEQ ID NO: 2020

SEQ ID NO: 6461 - DNA, 50 bp, Homo sapiens
agagacacctaaattacagatttgtgagctgagagctggagtttttcatt

SEQ ID NO: 6462 - DNA, 50 bp, Homo sapiens
aacagcaaagagagttacgaattacgttacttccagattaaccaggacga

SEQ ID NO: 6463 - DNA, 50 bp, Homo sapiens
agcgcaagatagatttggaataggaataagctctagttcttaacaaccga

SEQ ID NO: 6464 - DNA, 50 bp, Homo sapiens
gcatggacaagatgccaaggcccggatgctttaggatgaagttcttatct

SEQ ID NO: 6465 - DNA, 50 bp, Homo sapiens
cctccagtcaccatacacaggttaccagtgtcgaacttgatgaaatcagt

SEQ ID NO: 6466 - DNA, 50 bp, Homo sapiens
ccaaacatctggacttgtgactgtaaaaggggaggaggtagccaatgatt

SEQ ID NO: 6467 - DNA, 50 bp, Homo sapiens
ttatggtggtcggggtgggtggtagttcaatgggaggtatgggatttatt

SEQ ID NO: 6468 - DNA, 50 bp, Homo sapiens
agctgtctggctcaaagatctacattctgaagttggctggaaatgtcttg

SEQ ID NO: 6469 - DNA, 50 bp, Homo sapiens
ctggttcctaccagtgccagtgccttcagggcttcacaggccagtacctc

SEQ ID NO: 6470 - DNA, 50 bp, Homo sapiens
tgacacagactgtttcaatcttggagcagcgactgactttgacagaagat

SEQ ID NO: 6471 - DNA, 50 bp, Homo sapiens
tgctatttaaagcaccatgataaatatgaggccacttggaaatccatcca

SEQ ID NO: 6472 - DNA, 50 bp, Homo sapiens
gcaggcgatgctctataatctaaaatgtatctctctttccctaagctgaa

SEQ ID NO: 6473 - DNA, 50 bp, Homo sapiens
aagtaagaccacctgtgaacttgatcattatctggcgcacataggaagat

SEQ ID NO: 6474 - DNA, 50 bp, Homo sapiens
gctggggctgggaattgcgtgggctaatgtgtcatttgacttaagaaact

SEQ ID NO: 6475 - DNA, 50 bp, Homo sapiens
tttgggaagaaccgattgctaaattatgcctaattcatgtcagaagaggg

SEQ ID NO: 6476 - DNA, 50 bp, Homo sapiens
aagcagtataccatttatatagcaaacagccagtggccagttcactgtat

SEQ ID NO: 6477 - DNA, 50 bp, Homo sapiens
ctgccctttggtagtgagaggaccacgccaatgatgcttttaagtaacct

SEQ ID NO: 6478 - DNA, 50 bp, Homo sapiens
catttcttcatctctaaggcacacttgctacccctctttgctgaccccag

SEQ ID NO: 6479 - DNA, 50 bp, Homo sapiens
gcctgcgtgtctgtctcagtgtttcctggtcctcctctaagtactctaaa

SEQ ID NO: 6480 - DNA, 50 bp, Homo sapiens
aatcctagacatgtgcttgtcattgctcccatgaaggtagttttcaaaca

SEQ ID NO: 6481 - DNA, 50 bp, Homo sapiens
accaatagagaagaagctctagaagacaaaatcccaaaccttggcacaaa

SEQ ID NO: 6482 - DNA, 50 bp, Homo sapiens
ggcttcaacagaaacatcaaatgccaagaccagtgagagagcgtcaaaaa

SEQ ID NO: 6483 - DNA, 50 bp, Homo sapiens
gcaagcccactaaaataaacatctaaccagcatctttcccccattatagg

SEQ ID NO: 6484 - DNA, 50 bp, Homo sapiens
atggatctgttcctctgtgctaaatgtcttgtggcagggtgtgtttgtgg

SEQ ID NO: 6485 - DNA, 50 bp, Homo sapiens
gccgtaatgtctcgggatctctaataatagaggaggtgagttgtggtgtc

SEQ ID NO: 6486 - DNA, 50 bp, Homo sapiens
aggcactcctcaaccagtgttcactgaattcaactgctgaaattgtaaca

SEQ ID NO: 6487 - DNA, 50 bp, Homo sapiens
agagagggttttaagggagggcttgtgaatacttgggagaatacggaagg

SEQ ID NO: 6488 - DNA, 50 bp, Homo sapiens
atgaatttgaagacatggtggctgaaaagcggctcatcccagatggctgt

SEQ ID NO: 6489 - DNA, 50 bp, Homo sapiens
ttccacagataggtaagccaggcgcggcaagatgagactgtattcagtta

SEQ ID NO: 6490 - DNA, 50 bp, Homo sapiens
tcttgtcctagtcattgtggcaaccccatctgacaccttgtgtagtacct

SEQ ID NO: 6491 - DNA, 50 bp, Homo sapiens; identical to SEQ ID NO: 362

SEQ ID NO: 6492 - DNA, 50 bp, Homo sapiens
tttcaacatggctagatccatcagaaactgaaggcggggagaaagctctc

SEQ ID NO: 6493 - DNA, 50 bp, Homo sapiens
ggtactcaaaggaaattactctttctctggaaccctggcagaaagtttta

SEQ ID NO: 6494 - DNA, 50 bp, Homo sapiens
atccttcctaccttttattatgaaagttttggtacctggcccggcgagcg

SEQ ID NO: 6495 - DNA, 50 bp, Homo sapiens
attaaggtttttaacatctactttgggtgatggagccttcaatgaagtca

SEQ ID NO: 6496 - DNA, 50 bp, Homo sapiens
gaaagactacgaatttcgctgggaggtaatagggaagccttccacataaa

SEQ ID NO: 6497 - DNA, 50 bp, Homo sapiens
aaatgaggtcagcaataaccttgattcggtcctccactggcaacatttta

SEQ ID NO: 6498 - DNA, 50 bp, Homo sapiens
cttctctccctgtaaccaggcagtgtgtgggcggggctcagaacatatct

SEQ ID NO: 6499 - DNA, 50 bp, Homo sapiens
gttgccctgatctggaaatcctgttgcttcttctgggatgaaggaacctc

SEQ ID NO: 6500 - DNA, 50 bp, Homo sapiens
taagataacccacaggcacttcctgtcataaagccaacgacacagaccag

SEQ ID NO: 6501 - DNA, 50 bp, Homo sapiens
atgggaacaggatgttaaatacacacatacatacgcacacaagcgttggg

SEQ ID NO: 6502 - DNA, 50 bp, Homo sapiens
cctctgctatcactagagaatgtagagaatggaaatggctgcctttatgc

SEQ ID NO: 6503 - DNA, 50 bp, Homo sapiens
gatacagatgtgattattcagcctcaaggggacttctccattgcgtaacg

SEQ ID NO: 6504 - DNA, 50 bp, Homo sapiens
ttattgttaccaattagaatcagcaattcaactgtgcggtgatttggcct

SEQ ID NO: 6505 - DNA, 50 bp, Homo sapiens
tcatcacttgggttaactaaaggtttgcgtatcacacaattacactacaa

SEQ ID NO: 6506 - DNA, 50 bp, Homo sapiens
ttcatagtcaaacaaaaggtaagatcatgcatatacccacggcaacaagg

SEQ ID NO: 6507 - DNA, 50 bp, Homo sapiens
cccacccccttcccctccatgtgaagatttgggtgcttaacatatcattt

SEQ ID NO: 6508 - DNA, 50 bp, Homo sapiens
gggagacatgctgattccactcaaagatctcataataaacagctttggcc

SEQ ID NO: 6509 - DNA, 50 bp, Homo sapiens
aaataaatttggaatgggacattgtgctgtttcaccttcaatgctgttaa

SEQ ID NO: 6510 - DNA, 50 bp, Homo sapiens
agaacagtcttgggttcaggggtgtgatgccagaatgtattttcgtacct

SEQ ID NO: 6511 - DNA, 50 bp, Homo sapiens
aaggcgaagtcaatcccatctccctgaacccaactgccagtaggtagttc

SEQ ID NO: 6512 - DNA, 50 bp, Homo sapiens
agttaaactgttggtgaggtagtgtgtcaggtactctgtatattagctct

SEQ ID NO: 6513 - DNA, 50 bp, Homo sapiens
actggataaacagaacggatcaaagataaaagtattcttgttgcctgggc

SEQ ID NO: 6514 - DNA, 50 bp, Homo sapiens
gtcccttaggggagggagagttgtcctctttgcccacagtctaccctcag

SEQ ID NO: 6515 - DNA, 50 bp, Homo sapiens
actggactactgaactttagaatactgtcctaaggaaataggtctgggca

SEQ ID NO: 6516 - DNA, 50 bp, Homo sapiens
caaacaacaaaagtggcctccatcgctgtgagcctctcaagggacagggc

SEQ ID NO: 6517 - DNA, 50 bp, Homo sapiens
aaggtggctggcttttatgatacagtggtggtaatgtagccctttttggt

SEQ ID NO: 6518 - DNA, 50 bp, Homo sapiens
tgctcaattgccatacatgcactataggccgggatagaaaatcgtcagct

SEQ ID NO: 6519 - DNA, 50 bp, Homo sapiens
ttcaaggatgtgactgatatctggtgtggtttattttgtttgttttgggg

SEQ ID NO: 6520 - DNA, 50 bp, Homo sapiens
agctttggaaatttgaacaaggtggggacaaaatcaggcaataacagact

SEQ ID NO: 6521 - DNA, 50 bp, Homo sapiens
cacttcctgagtgtttcctgagaacaaaggatcagagcttcggctgtgag

SEQ ID NO: 6522 - DNA, 50 bp, Homo sapiens
ttttccttttcgctgactttcccactcactgtctgtctctcattttctct

SEQ ID NO: 6523 - DNA, 50 bp, Homo sapiens
gcatgggaattggctgtcatcactcatagcacggtgtataaactcaagga

SEQ ID NO: 6524 - DNA, 50 bp, Homo sapiens
gtccactcaagttacctggctgtctatcttttggctgacccctgaagcga

SEQ ID NO: 6525 - DNA, 50 bp, Homo sapiens
ctaagtaagcaaagaggcagaggggaggaggggagtgtttggtactgtcc

SEQ ID NO: 6526 - DNA, 50 bp, Homo sapiens
tggtgcggtgttcatgattattatgcagggtggaagttcagtatttggtc

SEQ ID NO: 6527 - DNA, 50 bp, Homo sapiens
agcacatttgtgcagaaaggttttgcaggtatctgaggcactgctcacct

SEQ ID NO: 6528 - DNA, 50 bp, Homo sapiens
agaacaacacgggattgaagtgggaagagatgggaccctcattggatctg

SEQ ID NO: 6529 - DNA, 50 bp, Homo sapiens
ggaacaatagacctcttcactagctccctgctgtttgatggtttggttgg

SEQ ID NO: 6530 - DNA, 50 bp, Homo sapiens
agaggatgactttgaggtaaatgtttacgatgcacggttttaggcgatgt

SEQ ID NO: 6531 - DNA, 50 bp, Homo sapiens
gtgtcctggggagtgaggagaggtggagtagactctgagaggagtgaaaa

SEQ ID NO: 6532 - DNA, 50 bp, Homo sapiens
agatcatgtctggattgtgtttcctattacctagagacgaacacagatct

SEQ ID NO: 6533 - DNA, 50 bp, Homo sapiens
gtgtcccaggacgagcgggagtgcaccatggacctctccgagttcatgaa

SEQ ID NO: 6534 - DNA, 50 bp, Homo sapiens
tgtatggcttatagccagagatgaaacagaacccaagttaatattgccag

SEQ ID NO: 6535 - DNA, 50 bp, Homo sapiens
aggtttcagaatctgggccttacctttacaggttcaacaaaagaatggca

SEQ ID NO: 6536 - DNA, 50 bp, Homo sapiens
aagatgaggcgtagctcatgtacaaatgcagcattctcataagtgcttta

SEQ ID NO: 6537 - DNA, 50 bp, Homo sapiens
agatagtggtatttgggtgctgggcttgtctgaactgaggaggtgggtgc

SEQ ID NO: 6538 - DNA, 50 bp, Homo sapiens
ccttgcaccagagacgactgacatatatagatgggagtcactcatgcgct

SEQ ID NO: 6539 - DNA, 50 bp, Homo sapiens
ggtgtagcgtgaagatctggacagcgcactacgacccgggccactgtttc

SEQ ID NO: 6540 - DNA, 50 bp, Homo sapiens
agaagcaaacctgtgaagctactatcgtttatcatcagtgtgaatgcact

SEQ ID NO: 6541 - DNA, 50 bp, Homo sapiens
tagtgatacaatttggggtgccagaggttgggggtaaggaattttgaagc

SEQ ID NO: 6542 - DNA, 50 bp, Homo sapiens
gtgtggcctaaggaacacctcttgtggggagtaagagccagcccttcctc

SEQ ID NO: 6543 - DNA, 50 bp, Homo sapiens
agatgcgggcgcaagcttatgtcctgttatgagggtttaaattagattgg

SEQ ID NO: 6544 - DNA, 50 bp, Homo sapiens
tcataacgcccttcaaaacattgaataaaatcagtgcaaaacattgagca

SEQ ID NO: 6545 - DNA, 50 bp, Homo sapiens
tgagaaaggagttagcagaatattaacataccgagaagctgttgttagca

SEQ ID NO: 6546 - DNA, 50 bp, Homo sapiens
ctggagactcaggtcgcttaagtggaggggacgggcacagccattcctcc

SEQ ID NO: 6547 - DNA, 50 bp, Homo sapiens
aaagacctgccacttatttttggctctcatctgtactcttaagtgtgtgt

SEQ ID NO: 6548 - DNA, 50 bp, Homo sapiens
agacacagctgcagaaaacttattcttttcaagcatgcacagtcacaaaa

SEQ ID NO: 6549 - DNA, 50 bp, Homo sapiens
cattcaacaacacaaaccgagcacctactgtgtgccacgccacagacaag

SEQ ID NO: 6550 - DNA, 50 bp, Homo sapiens
cctaggaaacacaggtcaaagaaacacagtccaacatgtattcagaattc

SEQ ID NO: 6551 - DNA, 50 bp, Homo sapiens
aaacgcaatctattttaggtttgagattagaagctgaggccaaggactca

SEQ ID NO: 6552 - DNA, 50 bp, Homo sapiens
tcctccagatgcatggtccgtgaagaaatttaatagcaaagacgagaaga

SEQ ID NO: 6553 - DNA, 50 bp, Homo sapiens
ggctctcatgcttatgccacacatccttgattctgcttaggagtctctgg

SEQ ID NO: 6554 - DNA, 50 bp, Homo sapiens
aagcctgagctaacaagagctgaggacagtagcttattcctctttatggg

SEQ ID NO: 6555 - DNA, 50 bp, Homo sapiens
tggatgatgggattggataagcatgtggactggattgtgttacaaactct

SEQ ID NO: 6556 - DNA, 50 bp, Homo sapiens
tgctgtttctaggattaacacgaaatcatcactttgccatattttgagct

SEQ ID NO: 6557 - DNA, 50 bp, Homo sapiens
ggctcagcacaaaagagaattcgtagcactttcatgtgaaagcagaccca

SEQ ID NO: 6558 - DNA, 50 bp, Homo sapiens
gatattaaggtactttcagtacaaatctggtgctgtgagtgggctcatcc

SEQ ID NO: 6559 - DNA, 50 bp, Homo sapiens
tccagtttctcataaacaaattcttctatcctggcatttggatttgggtt

SEQ ID NO: 6560 - DNA, 50 bp, Homo sapiens
tcatggtcatagctgtaacctgtgtgaaatagtaatcagatcaaaaagcg

SEQ ID NO: 6561 - DNA, 50 bp, Homo sapiens
atatgtacctggagggcggacgatcgaaattactagtgaattagcggcag

SEQ ID NO: 6562 - DNA, 50 bp, Homo sapiens
tgcgagtgtaatttctgtaaggagggtatgggataattaatagcacgcct

SEQ ID NO: 6563 - DNA, 50 bp, Homo sapiens
gcccccagcattcaattcattttgtacccttagtttaaagaacttctccc

SEQ ID NO: 6564 - DNA, 50 bp, Homo sapiens
aactttgctttctgaaggttttggtgtacctcgggcgcgaacacgctaat

SEQ ID NO: 6565 - DNA, 50 bp, Homo sapiens
attgactccactttgtgccaagctctgcgggtaggcatatttcatatctt

SEQ ID NO: 6566 - DNA, 50 bp, Homo sapiens
cagtggagaagctgcactgtctccgggcttgtgtgatccgatctctgtac

SEQ ID NO: 6567 - DNA, 50 bp, Homo sapiens
agctttgaaagtaatgtctaaccctgctgtcagtttatcacaagtgcatt

SEQ ID NO: 6568 - DNA, 50 bp, Homo sapiens
agcttaattgaattggaggagcaccgaacaggcagtttcctgagcagtgg

SEQ ID NO: 6569 - DNA, 50 bp, Homo sapiens
gctctcactgatctctcttctctatctctttctgcagttataccagcact

SEQ ID NO: 6570 - DNA, 50 bp, Homo sapiens
tgagaagagctgtgaaggcagaggcggggcaagtgcaaaggtcctgactt

SEQ ID NO: 6571 - DNA, 50 bp, Homo sapiens
aactccctgttcagttcagttgctaatgatctcaagctcttccctgatta

SEQ ID NO: 6572 - DNA, 50 bp, Homo sapiens
cagcctaatgcctaaccacacagataccattggtgggcgacgtgacccag

SEQ ID NO: 6573 - DNA, 50 bp, Homo sapiens
caccatcttttgctcggatactagcccgcaatacccactcacctaccacc

SEQ ID NO: 6574 - DNA, 50 bp, Homo sapiens
agggtctccaccttacagaagtacatgaacaaccagagatagcagggctg

SEQ ID NO: 6575 - DNA, 50 bp, Homo sapiens
accaggaaaagtaaaaatcatagttggtgtctctcgggtttctcaccttc

SEQ ID NO: 6576 - DNA, 50 bp, Homo sapiens
atgtatgagagagattcgagatgagttaaaggagggaagggaggggtggt

SEQ ID NO: 6577 - DNA, 50 bp, Homo sapiens
catgagtattggcactggggttcaagttccagggcagagcaggataagag

SEQ ID NO: 6578 - DNA, 50 bp, Homo sapiens
ctcctggggctggagtcctggtctgccttctggggacagagattaggtcg

SEQ ID NO: 6579 - DNA, 50 bp, Homo sapiens
tggaacttcagtcaaaaacatctgtactttgtacaggacaaagatttggc

SEQ ID NO: 6580 - DNA, 50 bp, Homo sapiens
atagaacttgttttacctatgagccttgccttgtatttattcactgtggc

SEQ ID NO: 6581 - DNA, 50 bp, Homo sapiens
acatctcttgtgaaagttcaaatgttacagcaaggtgtaaacactccact

SEQ ID NO: 6582 - DNA, 50 bp, Homo sapiens
gggtgaattaatcgggagatgggtagtcagggcaaatgatgggtgggttt

SEQ ID NO: 6583 - DNA, 50 bp, Homo sapiens
tgcaattgtggagacaaattgttagagtttaaatcctggctctgttccct

SEQ ID NO: 6584 - DNA, 50 bp, Homo sapiens
ggacctatgtcctcaagacatggaaactactagttctgtcgtgccaggag

SEQ ID NO: 6585 - DNA, 50 bp, Homo sapiens
aattaaggatgccctaccgacatctatcagcatacctggaacaggttcga

SEQ ID NO: 6586 - DNA, 50 bp, Homo sapiens
cggccaacccaggagggcaggtgttttgggcatctggtttatagtacctc

SEQ ID NO: 6587 - DNA, 50 bp, Homo sapiens
gctggggtgaaaacttgaagactcagacctcagtggaaacagatgaatgt

SEQ ID NO: 6588 - DNA, 50 bp, Homo sapiens
ccccaggctctgtgacgcttgaaattctaattagcgcagaaaagggctaa

SEQ ID NO: 6589 - DNA, 50 bp, Homo sapiens
cctgactacgtgttttccccacagacatcacactggttcacctcgttgaa

SEQ ID NO: 6590 - DNA, 53 bp, Homo sapiens
aatggaaagacacttctgtatacactggaaatctcaggaaatttcttttttcc

SEQ ID NO: 6591 - DNA, 50 bp, Homo sapiens
gacagtacagtaccctaagagcactgaggagggccaccccacgtgaactc

SEQ ID NO: 6592 - DNA, 50 bp, Homo sapiens
tttccttggagatttcaggcatcttaggccggaagggacctcgaaggtgg

SEQ ID NO: 6593 - DNA, 50 bp, Homo sapiens
ctccgcttctttcactcattcgtttagtgtttctttaagctttgccttgt

SEQ ID NO: 6594 - DNA, 50 bp, Homo sapiens
tccacattttgatcatgcatttatgaaagccctgggtttgttattgagaa

SEQ ID NO: 6595 - DNA, 50 bp, Homo sapiens
gctatcttctgctgaatcagcgtaatgctgatatacaccctattttctgt

SEQ ID NO: 6596 - DNA, 50 bp, Homo sapiens
aaaagaaaagtttttcaacccagggaatttatagtgggtgtcagtcgaga

SEQ ID NO: 6597 - DNA, 50 bp, Homo sapiens
aggagacgatgtagggggaagtgtgttagattgtaatggaggggtttgga

SEQ ID NO: 6598 - DNA, 50 bp, Homo sapiens
gctctttcccagacccagccgccaggttctctgtagaagaaaataaatgc

SEQ ID NO: 6599 - DNA, 50 bp, Homo sapiens
aaggaggaatgggaatctcaagctcaagggcactctcactaattgtgggt

SEQ ID NO: 6600 - DNA, 50 bp, Homo sapiens
aaatagccaccttctccccattttctgtcagaacacacactttatatcca

SEQ ID NO: 6601 - DNA, 50 bp, Homo sapiens
tttggtaaaagagattggaggggacaccagggaaaccaggattttctggc

SEQ ID NO: 6602 - DNA, 50 bp, Homo sapiens
aagtgctaaggcattctctaaactatctttccagctccgggcgacaatgg

SEQ ID NO: 6603 - DNA, 50 bp, Homo sapiens
ccactctctaagtcaagcgagtccttcctgcatacctgtactgggtgctg

SEQ ID NO: 6604 - DNA, 50 bp, Homo sapiens
ggactttgcaggcttcattccctgtctgtgtcttttccttctggtgtgtt

SEQ ID NO: 6605 - DNA, 50 bp, Homo sapiens
atttgctggccaatcctgctgactatgaatctttgggggcactgagttac

SEQ ID NO: 6606 - DNA, 50 bp, Homo sapiens
ctggggtactggggaaaaggaactggtattgagattttatatttggggcg

SEQ ID NO: 6607 - DNA, 50 bp, Homo sapiens
ttgagtaaggctcagagttgcagatgaggtgcagagaacatcctgtgact

SEQ ID NO: 6608 - DNA, 50 bp, Homo sapiens
ggtcacagagagaaatggtagctgaagaagcagggcacgagggctctaac

SEQ ID NO: 6609 - DNA, 50 bp, Homo sapiens
tttccggtatattcgtgtgggttgactttttgtgtgtgtggttgtggtgg

SEQ ID NO: 6610 - DNA, 50 bp, Homo sapiens
ggatctcttgctcctctcacctgtgtgacagactactaacagcccaactg

SEQ ID NO: 6611 - DNA, 50 bp, Homo sapiens
acagtgtgggacagaagagtgctcagtgattaaatgcctgataatagatt

SEQ ID NO: 6612 - DNA, 50 bp, Homo sapiens
ctctctcgcaatttacaaccgctttcagtaccattcaccgtcactcctct

SEQ ID NO: 6613 - DNA, 50 bp, Homo sapiens
ctttggggagtggagttgttgtagatggggagagaatcagaacaaggaga

SEQ ID NO: 6614 - DNA, 50 bp, Homo sapiens
ccttactgcttacggtcatcggtcatcagcccaacccgcttggttaggtg

SEQ ID NO: 6615 - DNA, 50 bp, Homo sapiens
agagtataatttccccagtgtggagtggttagtgttgctaaagaagaggt

SEQ ID NO: 6616 - DNA, 50 bp, Homo sapiens
ctgatgtcgtgtctgcactcacctggtcatgtgttctgttgtgcggtagt

SEQ ID NO: 6617 - DNA, 50 bp, Homo sapiens
aggggcagagaagaatccacactcacaagagatgaccaggagtaaaactg

SEQ ID NO: 6618 - DNA, 50 bp, Homo sapiens
cccagcagaggccaacaagcagccatacccaaacttcagccaaaataaaa

SEQ ID NO: 6619 - DNA, 50 bp, Homo sapiens
tgtgcaaatacggcgagaagaagtgcatgagaaagtgctttataagctgt

SEQ ID NO: 6620 - DNA, 50 bp, Homo sapiens
ccagcttttcctttgatgttagttagcagtaagtcacaggtttgagcccc

SEQ ID NO: 6621 - DNA, 50 bp, Homo sapiens
ggcacgcatcctcattcctgcatgctcttagaatatctatcaatgatcat

SEQ ID NO: 6622 - DNA, 50 bp, Homo sapiens
acttctatactcagtgcgctgtgggtaaccaagcaagcaggtttgttgtc

SEQ ID NO: 6623 - DNA, 50 bp, Homo sapiens
gcgggatggtgggaagacagacactgccttagagcatgaataattgaaga

SEQ ID NO: 6624 - DNA, 52 bp, Homo sapiens
aggtagactatttagctggaagcatccaaacaggggattttaaaaatactca

SEQ ID NO: 6625 - DNA, 52 bp, Homo sapiens
aaaatgtaggttaaaactctcacttaagaaggagaagatctgagtaaaccca

SEQ ID NO: 6626 - DNA, 50 bp, Homo sapiens
acctgaacaatgaatgaagaaaggaagacttggttcttctagctctggac

SEQ ID NO: 6627 - DNA, 50 bp, Homo sapiens
catggctcacaagctctaacactcccctccctccagatcctaagaagaag

SEQ ID NO: 6628 - DNA, 50 bp, Homo sapiens
tctgagcttcacttcaagaactggtagtccaaaagaactggttcgttcag

SEQ ID NO: 6629 - DNA, 50 bp, Homo sapiens
acttcactcactttttagcctgttcatatgagcttgtcagtgcttttgtt

SEQ ID NO: 6630 - DNA, 50 bp, Homo sapiens
tgaggaggatgggaggcgcacaggcaatttagctagatatagaaagagaa

SEQ ID NO: 6631 - DNA, 50 bp, Homo sapiens
agctgatttggattcttgcggtttgcatcggtctaatttatcaagtgtgt

SEQ ID NO: 6632 - DNA, 50 bp, Homo sapiens
tccatccttggaagcttgacaagcattcacactactggctcacctactat

SEQ ID NO: 6633 - DNA, 50 bp, Homo sapiens
tagcactgtagccagagtccctgcttgtaccaggaagctgggtggtggtt

SEQ ID NO: 6634 - DNA, 50 bp, Homo sapiens
tggatagtcagaattacgtgttttgtggattggggagggaggggaggaaa

SEQ ID NO: 6635 - DNA, 50 bp, Homo sapiens
gcactcctggaaccttctcactaattcggggaccagttttgtgaatgttg

SEQ ID NO: 6636 - DNA, 50 bp, Homo sapiens
ttgctgcggatgacctgactgagccctgggagactgtgctataatctctc

SEQ ID NO: 6637 - DNA, 50 bp, Homo sapiens
agaaggaggatctgttctaaacatctgcgaggggaggacaaagcattgaa

SEQ ID NO: 6638 - DNA, 50 bp, Homo sapiens
cttgcatctgagtgaagatgaacctttctttcccagccctgagagaggga

SEQ ID NO: 6639 - DNA, 50 bp, Homo sapiens
gtctagctggcaggtgatggatgaatggatgagctggcagaccaacagaa

SEQ ID NO: 6640 - DNA, 50 bp, Homo sapiens
tgcatggaaatgtttcgagtacggggaaaataagggagccaaaactgtgt

SEQ ID NO: 6641 - DNA, 50 bp, Homo sapiens
ttttaaggtgtgactcaatttacaggcattctgtatttttgcgatttggt

SEQ ID NO: 6642 - DNA, 50 bp, Homo sapiens
acctttgggagaaagtcttacaactacatgaaatgcagatttatggactc

SEQ ID NO: 6643 - DNA, 50 bp, Homo sapiens
gaagggacagaacaatcaactgtgagagatgggaagaaaactcaaatgga

SEQ ID NO: 6644 - DNA, 50 bp, Homo sapiens
ctagtttggggactttcattgggcacgtgaatccaggagggctgaatttt

SEQ ID NO: 6645 - DNA, 50 bp, Homo sapiens
ggcccagattgtagacagcataaaaataattttgggcttttcctgttaaa

SEQ ID NO: 6646 - DNA, 50 bp, Homo sapiens
ctgggcttcttgtgtgagaagcaccgcagccaagaacaaccagtgcaact

SEQ ID NO: 6647 - DNA, 50 bp, Homo sapiens
gaagggggattcggtgatgggggaagccaagggacaagggaaaaaggaaa

SEQ ID NO: 6648 - DNA, 50 bp, Homo sapiens
aacccaaccatgaaaaagaagaagctctggactacggccaggcgtgggag

SEQ ID NO: 6649 - DNA, 50 bp, Homo sapiens
tggctatttgagttttctcttacatgaaatgcctggcaacgtacactggc

SEQ ID NO: 6650 - DNA, 50 bp, Homo sapiens
tgaactctgatttccgccgaaactaggaggaaacacccaaaagaagacgg

SEQ ID NO: 6651 - DNA, 50 bp, Homo sapiens
tttgctgggactaaaatcaaaactgcactgcagagcaggtgagggttcat

SEQ ID NO: 6652 - DNA, 58 bp, Homo sapiens
tggagagtgtgtgtattaccatttttttacattgcatcacattttaccatctatatct

SEQ ID NO: 6653 - DNA, 50 bp, Homo sapiens
tttgaagcccctcatagagaagagactgtaccataagagaagcccactca

SEQ ID NO: 6654 - DNA, 50 bp, Homo sapiens
aactctcagtccatgagcttgattactccattgtaccatttggaagccca

SEQ ID NO: 6655 - DNA, 50 bp, Homo sapiens
gtgggtagccattaagtggtctggcacagaaagggacaagtagcttcaag

SEQ ID NO: 6656 - DNA, 50 bp, Homo sapiens
ctggtgctgagtggagtcacagtaaggctgtagatggagcgccctgggaa

SEQ ID NO: 6657 - DNA, 50 bp, Homo sapiens
ttttgatgtgaccagtcgtgcatggcgggggacaggagcttagggggaat

SEQ ID NO: 6658 - DNA, 50 bp, Homo sapiens
attatgcatgtcgaggggacaacttttattaaacaggaggggtgtgtctt

SEQ ID NO: 6659 - DNA, 50 bp, Homo sapiens
tggtcatgtttccctctttactccacgacagtttcattattgtaaccagg

SEQ ID NO: 6660 - DNA, 50 bp, Homo sapiens
ttctgttggttatatgaatggcagttattgtctcccagtgtgtgggttct

SEQ ID NO: 6661 - DNA, 50 bp, Homo sapiens
agtcctggcaactttacctgggaattgtctgtaatctttaagcagtggcg

SEQ ID NO: 6662 - DNA, 50 bp, Homo sapiens
aggacttatctagctttcacagattcagagtgcgtttcaaacatcattgt

SEQ ID NO: 6663 - DNA, 50 bp, Homo sapiens
tttaacaggcttatctaggacataggcccaagagggaggaggaggaaggc

SEQ ID NO: 6664 - DNA, 50 bp, Homo sapiens
ctccaggccgaacgagcctccactctggattaagatctgtcatcttgaca

SEQ ID NO: 6665 - DNA, 50 bp, Homo sapiens
gcaggacttgtggcaggactcaacgggagagaaagaggctgaaacataaa

SEQ ID NO: 6666 - DNA, 50 bp, Homo sapiens
aagaacatcccaacttttccggtaggcaagtgtcaagtcacctggacaat

SEQ ID NO: 6667 - DNA, 50 bp, Homo sapiens
tctgtggcttgttgtgggaccctgcgccctttaaattagggcatatttta

SEQ ID NO: 6668 - DNA, 50 bp, Homo sapiens
gcgctaaaaacctggtgattaaatgacaaacagaacgtgagaagagattt

SEQ ID NO: 6669 - DNA, 50 bp, Homo sapiens
tcctgcacacaacaaataaagacaagaataaagggccacccatcagtagc

SEQ ID NO: 6670 - DNA, 50 bp, Homo sapiens
atgttgttcaaattaaacatcataccacatgggggcagctaccaattttt

SEQ ID NO: 6671 - DNA, 50 bp, Homo sapiens
taatatgaaaagctggaaaagaattaaggggttgaggagacgtgccgggt

SEQ ID NO: 6672 - DNA, 50 bp, Homo sapiens
gttaccctgacgaatgcagtcctcgtgtggaatgtctatgccctcttgag

SEQ ID NO: 6673 - DNA, 50 bp, Homo sapiens
acaccagcagtcataggggaaaggggaatacagttaattgggtatttgtt

SEQ ID NO: 6674 - DNA, 50 bp, Homo sapiens
actccctcccatctctggtctttagttggaagcaagctttcggacaacgg

SEQ ID NO: 6675 - DNA, 50 bp, Homo sapiens
tccaacaagggttacggcagaatttatgcgaaagtcttctttgggctaaa

SEQ ID NO: 6676 - DNA, 50 bp, Homo sapiens
ttgttctgctcaggccaaggattgttgtgtgctctgtatttgctgctttg

SEQ ID NO: 6677 - DNA, 50 bp, Homo sapiens
ggcccggcatgtcttcgttttgtcagtcctcatccaatccatcttcatat

SEQ ID NO: 6678 - DNA, 50 bp, Homo sapiens
gtgggtttttagacacctgcagcaagaagaaatactgactgactaggcat

SEQ ID NO: 6679 - DNA, 50 bp, Homo sapiens
ttttaaagaaaaatctattatcttggagcatggatgggggaatgcgaagg

SEQ ID NO: 6680 - DNA, 50 bp, Homo sapiens
cagaagaaacatggcaaactgctctgtgctttcaaaccaaagtgttcccc

SEQ ID NO: 6681 - DNA, 50 bp, Homo sapiens
gttacttaagatcagtatgtgtggtgcatatgtgatttcgaccattcagt

SEQ ID NO: 6682 - DNA, 50 bp, Homo sapiens
gagaatttccgtctgatctatgacaccaagggtcgctttgctgtacctcg

SEQ ID NO: 6683 - DNA, 50 bp, Homo sapiens
ctgggttaatactcaccaactttgagaaggttggtctctgctcttctgta

SEQ ID NO: 6684 - DNA, 50 bp, Homo sapiens
ggaaagacaggtgagtgtgccacaactacctaacacatcagcaaatctgg

SEQ ID NO: 6685 - DNA, 50 bp, Homo sapiens; identical to SEQ ID NO: 378

SEQ ID NO: 6686 - DNA, 50 bp, Homo sapiens
cgataagctgtggtgttgggagtgagagatgttactttgcgaatgttcaa

SEQ ID NO: 6687 - DNA, 50 bp, Homo sapiens
aaaggctaggtttgcgaaagcccttctaaaactatgctttggtggttact

SEQ ID NO: 6688 - DNA, 50 bp, Homo sapiens
ctgaccctgccgggcggaagataaaacaaaaacgagaagaacaagcaaga

SEQ ID NO: 6689 - DNA, 50 bp, Homo sapiens
aagattgtaaaaatacattttaggctcaagagttccaggggtttcagagc

SEQ ID NO: 6690 - DNA, 50 bp, Homo sapiens
tgcaagctggcaccttcacgtttatttttaaagggcttcacatcaaagat

SEQ ID NO: 6691 - DNA, 50 bp, Homo sapiens
aaacaaagaaggaaaatgaagagggggaaaagatgaacatcaggctgggt

SEQ ID NO: 6692 - DNA, 50 bp, Homo sapiens
tccaaaggatgttctggtgttgcagcatgatttctggtgttagtctttct

SEQ ID NO: 6693 - DNA, 50 bp, Homo sapiens
tttgtgggtgcgtgagaggggatttatactccttgagccatattttgtga

SEQ ID NO: 6694 - DNA, 50 bp, Homo sapiens
gggttcacagcatgggtggaggtaagtagtattctcattggttggttagt

SEQ ID NO: 6695 - DNA, 50 bp, Homo sapiens
gacagtgagaagaatatggagtagagtccttttggtctttgaggcggtca

SEQ ID NO: 6696 - DNA, 50 bp, Homo sapiens
aacagctgaagaacaagaaggtgagctctgaatgcgtcaggtggtcattc

SEQ ID NO: 6697 - DNA, 50 bp, Homo sapiens
ggctgaccagtacaggcttgggaattttatggttgggtggtttctaccaa

SEQ ID NO: 6698 - DNA, 50 bp, Homo sapiens
gggggagctatattactgattaaaaccaccatttcttcacccaacttatg

SEQ ID NO: 6699 - DNA, 50 bp, Homo sapiens
aagtcttgtattatgaggtactggggctctgggggatattgagatgagaa

SEQ ID NO: 6700 - DNA, 50 bp, Homo sapiens; identical to SEQ ID NO: 382

SEQ ID NO: 6701 - DNA, 50 bp, Homo sapiens
ggagcttccagtctaatagaaaagatgcacttacgaatagactttgggta

SEQ ID NO: 6702 - DNA, 50 bp, Homo sapiens
tctgtgctctgtggacccgtcaccctgagctcctcagttgctgaaccatc

SEQ ID NO: 6703 - DNA, 50 bp, Homo sapiens
tgctggcatgtggatagactttagcaaatggtagtcatcttctaatttct

SEQ ID NO: 6704 - DNA, 50 bp, Homo sapiens
aatgggaatcttaaggcctctctggaaagggtgtgagggggtcgaggggg

SEQ ID NO: 6705 - DNA, 50 bp, Homo sapiens
tgcatattgtcactgactggctagggtctctaaatttatgaaaccttaca

SEQ ID NO: 6706 - DNA, 52 bp, Homo sapiens
gtcagcaactaaaaagggagatatatcttagagagactggaataagcaactc

SEQ ID NO: 6707 - DNA, 50 bp, Homo sapiens
ggaaggactcaaactggccataaaggcaatacggcatgttcattacacca

SEQ ID NO: 6708 - DNA, 50 bp, Homo sapiens
tttgttgactatgaaatagtggtcctggttttaactctttggggttccct

SEQ ID NO: 6709 - DNA, 50 bp, Homo sapiens
aattatattttaggctgatgtgggtggtctgtaatgctctcatttaccac

SEQ ID NO: 6710 - DNA, 50 bp, Homo sapiens
ctgtgtttctgtatggtattgcatttgtcccggcctgttgggtttggtgg

SEQ ID NO: 6711 - DNA, 50 bp, Homo sapiens
ttcatgctcattaggacattgaacaaatggcagagtaagaaagtttggcc

SEQ ID NO: 6712 - DNA, 50 bp, Homo sapiens
gggaatggactcatatgcaagattgctgacttcggattggcccgattgat

SEQ ID NO: 6713 - DNA, 50 bp, Homo sapiens
caacacatgggacgggaaggaaatccttccgtgtgattttgttaaaaata

SEQ ID NO: 6714 - DNA, 50 bp, Homo sapiens
cagccacctcctcaggtcagacaagcccagcacccaaataccactatctg

SEQ ID NO: 6715 - DNA, 50 bp, Homo sapiens
ggcttccctattacctcccagcgaaattcgtagtctttctctatggagtt

SEQ ID NO: 6716 - DNA, 50 bp, Homo sapiens
tgctgatgtgttaggtagttgtggcacactcacctgtctttcctaaatgc

SEQ ID NO: 6717 - DNA, 50 bp, Homo sapiens
ttcatgctcagcaaaacaacgttttaggatggtgagagaagacaaagtaa

SEQ ID NO: 6718 - DNA, 50 bp, Homo sapiens
tattaaccactcacgggagctctccatgcatttggtattttcgtctgggg

SEQ ID NO: 6719 - DNA, 50 bp, Homo sapiens
ttacctgctttgcatgctctccatcgtcaaagtcttctggaaacttaggc

SEQ ID NO: 6720 - DNA, 50 bp, Homo sapiens
ccccaccccaacacatacaaacgtttcccaccaatccttgaactgcaaaa

SEQ ID NO: 6721 - DNA, 50 bp, Homo sapiens
ttcaaggtcccaatacccaactaactcgaaggaagaaatggaaatctatt

SEQ ID NO: 6722 - DNA, 50 bp, Homo sapiens
tgcacagaactcttacttacatgtctcatcgaaactccagaacaccgtcg

SEQ ID NO: 6723 - DNA, 50 bp, Homo sapiens
tgcatgtatcccggtaattcaaatccaatttcacagccactgctgaatat

SEQ ID NO: 6724 - DNA, 50 bp, Homo sapiens
tacaggaaaatgaaactagacgggtgggggacactagaatgaaaaccagt

SEQ ID NO: 6725 - DNA, 50 bp, Homo sapiens
agtttctgctttcagtgactgaggctttgctttaacctggtgactcccaa

SEQ ID NO: 6726 - DNA, 50 bp, Homo sapiens
tcccacttcaagttaagcaccaaagcaatcactaattctggagcacagga

SEQ ID NO: 6727 - DNA, 50 bp, Homo sapiens
catggatgggggcagtggtgtttctagtgtgtgaggaagcagagcagatg

SEQ ID NO: 6728 - DNA, 50 bp, Homo sapiens
tcaccacagatgggaagatcgtttcctgaaaacagtctataaatcacaga

SEQ ID NO: 6729 - DNA, 50 bp, Homo sapiens
cagacgctccagtgctgccgaggttagtgtgtttattagacctgaaatga

SEQ ID NO: 6730 - DNA, 50 bp, Homo sapiens
ccctttaggcctcttgcccgaacagtgaacactaatagatatcctaagct

SEQ ID NO: 6731 - DNA, 50 bp, Homo sapiens
atggggatcatgttttatttttctctatataatgggccagtgtgttccca

SEQ ID NO: 6732 - DNA, 50 bp, Homo sapiens
agctgtagaccataagccaccttcaggtagtggtttgggaaatcaagcaa

SEQ ID NO: 6733 - DNA, 50 bp, Homo sapiens
tgtacttatgcttgtcttctctacctgcccccagtcttgaagtggtggaa

SEQ ID NO: 6734 - DNA, 50 bp, Homo sapiens
ggagggtgtgggaagcaagagaagaacattctgttaggggcagagaagaa

SEQ ID NO: 6735 - DNA, 50 bp, Homo sapiens
gcatctccagctttcatagttacccaacttgtaaaccagaagatgtgctg

SEQ ID NO: 6736 - DNA, 50 bp, Homo sapiens
ggccagtgccagacggtagctagttggatgctaaaggtagaatttagata

SEQ ID NO: 6737 - DNA, 50 bp, Homo sapiens
ggcattgtaggttgacaccagcaaagactcagagtgacttgagcattgga

SEQ ID NO: 6738 - DNA, 50 bp, Homo sapiens
agcccatttggatatggcccatctttacctaatggctactatagtgaggt

SEQ ID NO: 6739 - DNA, 50 bp, Homo sapiens; identical to SEQ ID NO: 4953

SEQ ID NO: 6740 - DNA, 50 bp, Homo sapiens
aatggtcaggcacaggtagaatcaaagtcctgtatgtatgttcacacaga

SEQ ID NO: 6741 - DNA, 50 bp, Homo sapiens
tacctgaaggtgtagagagtgcccgcatccagcaaggccaacagctccac

SEQ ID NO: 6742 - DNA, 50 bp, Homo sapiens
ctgtgtttttcccaaagcaacaatttcaaacaaagtgagagccactgaca

SEQ ID NO: 6743 - DNA, 50 bp, Homo sapiens
gactccgagctcaagtcagtctgtacccccaacccctaacccactgcatc

SEQ ID NO: 6744 - DNA, 50 bp, Homo sapiens
tgtaactgactttatgtatcactcaagtcttgcctttactgagtgcctga

SEQ ID NO: 6745 - DNA, 50 bp, Homo sapiens
tctctctaaccaaaactgtaatcttcaggaccagcaaactcagcccaagg

SEQ ID NO: 6746 - DNA, 50 bp, Homo sapiens
aactcttggttaaatgggttaatagaggattggaacactttgtttgctgt

SEQ ID NO: 6747 - DNA, 50 bp, Homo sapiens; identical to SEQ ID NO: 6540

SEQ ID NO: 6748 - DNA, 50 bp, Homo sapiens
ggactaacttccacctcctctgctacttccagctgcttctaatcacactt

SEQ ID NO: 6749 - DNA, 50 bp, Homo sapiens
agtcttccacccagcataggtatcacacaaccagctctgttttactcctg

SEQ ID NO: 6750 - DNA, 50 bp, Homo sapiens
ttagctggtacattgttcagagtttactgggagccggtaagatagtcacc

SEQ ID NO: 6751 - DNA, 50 bp, Homo sapiens
agcgtgatgcttcctcatgtcggtgattttctgttgagacatcttcaagc

SEQ ID NO: 6752 - DNA, 56 bp, Homo sapiens
cagggttaacaaaagtatggaattcaattctttttatatgctgcagccatgttcct

SEQ ID NO: 6753 - DNA, 50 bp, Homo sapiens
tgtaattgatttccgcataaacggtcattactggcacctatggcagcacc

SEQ ID NO: 6754 - DNA, 50 bp, Homo sapiens
gtgatccacttggagctgctactggtcccattgagtcctatagtacttca

SEQ ID NO: 6755 - DNA, 50 bp, Homo sapiens
tgccatgaaatctctattaattctcagaaagatcaaaggaggtcccgtgt

SEQ ID NO: 6756 - DNA, 50 bp, Homo sapiens
cccacctggcaaatcctcaagtgtgaccctagtcatctttctccttttgg

SEQ ID NO: 6757 - DNA, 50 bp, Homo sapiens
gctaaacagaaaagaacctgaagtacagttcccgtcttcaaagaagatgc

SEQ ID NO: 6758 - DNA, 50 bp, Homo sapiens
atcctcctcccctgggatggcatagaagagactttaaaaccaaatgagcc

SEQ ID NO: 6759 - DNA, 50 bp, Homo sapiens
gtcagtaagctctgcctgccaagaagacacagtgagaggtgtccacagtc

SEQ ID NO: 6760 - DNA, 50 bp, Homo sapiens
gtttccacttagttacttcttcctacctgctgtgaagctctgcaccctgc

SEQ ID NO: 6761 - DNA, 50 bp, Homo sapiens
agagtaatccacatcccagggacagtcacaatgacctacggctttagctg

SEQ ID NO: 6762 - DNA, 50 bp, Homo sapiens
gcagggctacaccaagtccattgatatttggtctgtaggctgcattctgg

SEQ ID NO: 6763 - DNA, 50 bp, Homo sapiens
tcttctctaaaatgccctcctctccttcctttttccagacctggtttaaa

SEQ ID NO: 6764 - DNA, 50 bp, Homo sapiens
tcgccatttggtagttccacagtgactgctcttctattttacgaagccac

SEQ ID NO: 6765 - DNA, 50 bp, Homo sapiens
gtagattactatgagaccagcagcctctgctcccagccagctgtggtgtg

SEQ ID NO: 6766 - DNA, 50 bp, Homo sapiens
tttccttttcgctgactttctcactcactgtctgtctctcattttctcca

SEQ ID NO: 6767 - DNA, 50 bp, Homo sapiens
tggtaagtttctggcagtgtggagacaggggaataatctcaacagtaggt

SEQ ID NO: 6768 - DNA, 50 bp, Homo sapiens
ccatggtggtgcttgactttgctttggggcttaatcctagtatcatttgg

SEQ ID NO: 6769 - DNA, 50 bp, Homo sapiens
tcagtgggtgttggttgtccattagttgagacttagttgttgctctggga

SEQ ID NO: 6770 - DNA, 50 bp, Homo sapiens
ggctggacagcagatgattcaaatctcaatactacatgcccattctgtgg

SEQ ID NO: 6771 - DNA, 50 bp, Homo sapiens
caggatggaacaagactccagcccctgcctgtctcatgtatctgcaaggg

SEQ ID NO: 6772 - DNA, 50 bp, Homo sapiens
cttcagtgcgtacacgagctcaacgttagtgccaggaaagacaactactc

SEQ ID NO: 6773 - DNA, 50 bp, Homo sapiens
actcgtatgccaactcttctgtcttcactactagagtgtagattggactc

SEQ ID NO: 6774 - DNA, 50 bp, Homo sapiens
tggactggaacttgactcgaagttatgtggcttaatgagtaagttcagcc

SEQ ID NO: 6775 - DNA, 50 bp, Homo sapiens
actggttcatttgtttcccgatagagctttattggaggaggcttgagagc

SEQ ID NO: 6776 - DNA, 50 bp, Homo sapiens
accatctcctttaatcctcacagtgatcctggagcaatgtgtgcattcct

SEQ ID NO: 6777 - DNA, 50 bp, Homo sapiens
catcacctgctcacctaggaaccaggagtactgggaactgttccgttact

SEQ ID NO: 6778 - DNA, 50 bp, Homo sapiens
tcattgctgatgatcttgaggctgttgtcgaacttctcatggttcacacc

SEQ ID NO: 6779 - DNA, 50 bp, Homo sapiens
tggcaccacgctgattattttccttttcaaatcccagcctatacacctcc

SEQ ID NO: 6780 - DNA, 50 bp, Homo sapiens; identical to SEQ ID NO: 327

SEQ ID NO: 6781 - DNA, 50 bp, Homo sapiens
aggcctttttatttgtctgtttagatacactgcttcctatatctgctgga

SEQ ID NO: 6782 - DNA, 50 bp, Homo sapiens
cccgtgccccaccagtctcactgcctgactccaagtctcgtacactagat

SEQ ID NO: 6783 - DNA, 50 bp, Homo sapiens
agcgatgaactgttgcaaaagaattttccagagcattttccattaaacca

SEQ ID NO: 6784 - DNA, 50 bp, Homo sapiens
ccatattcttgttccccagccaggtgctgcacctccccactcttttagtg

SEQ ID NO: 6785 - DNA, 50 bp, Homo sapiens
aaatgcttaaaggaacaatatatgtccctttcgaggcacgtgattcgttt

SEQ ID NO: 6786 - DNA, 50 bp, Homo sapiens
tctggagccacacccttaccatcaccttccaaagaagaaattgaaccctt

SEQ ID NO: 6787 - DNA, 50 bp, Homo sapiens
aatcacacaaggtcgaaagtagacagtcctcttggacttggaattgtcca

SEQ ID NO: 6788 - DNA, 50 bp, Homo sapiens
actttcctccgggaagtttgtatcttagcgtggacaacaggttaacacaa

SEQ ID NO: 6789 - DNA, 50 bp, Homo sapiens
tcaggatgctctcactttaagaaccgggcaaataatagaacactgtgaca

SEQ ID NO: 6790 - DNA, 50 bp, Homo sapiens
acttcactcagagtaaatgaaaagactgggtgcctcatcaatatcattgt

SEQ ID NO: 6791 - DNA, 50 bp, Homo sapiens
tgactgaaggcaagctcacagatgaagcagaggactgaagatctcgatct

SEQ ID NO: 6792 - DNA, 50 bp, Homo sapiens
gctgagaaggatgtggtataaatgtattaagcagcttagggtctctggcc

SEQ ID NO: 6793 - DNA, 50 bp, Homo sapiens
aagtccccgtctagtgggaaagaaagaagttgaacaagtaattccaaggg

SEQ ID NO: 6794 - DNA, 50 bp, Homo sapiens
cgcccggcaagtactggggtttcttatagcttctctctgcatctacaaag

SEQ ID NO: 6795 - DNA, 54 bp, Homo sapiens
ctgtttctctattttaacttacattggttattctgtaaagtcagatgtggcagt

SEQ ID NO: 6796 - DNA, 50 bp, Homo sapiens
gcactgtccttcccagttctacatttgagtctgagttgactcgcaagact

SEQ ID NO: 6797 - DNA, 50 bp, Homo sapiens
aacagattgtgcttctgttctgaatcttctaaagccatctgcacagtgct

SEQ ID NO: 6798 - DNA, 50 bp, Homo sapiens
aacagattgtgcttctgttctgaatcttccaaagccatctgcacagtgct

SEQ ID NO: 6799 - DNA, 50 bp, Homo sapiens
atctgcacagtgttagcatggtgactccagtgtcctccaagactccatag

SEQ ID NO: 6800 - DNA, 50 bp, Homo sapiens
tttagcatccactagttactgtctggcactggccacgaagggtgacaggg

SEQ ID NO: 6801 - DNA, 50 bp, Homo sapiens
gaatcccggtcatctctacccaagtcccggtctctctaccctattctctc

SEQ ID NO: 6802 - DNA, 50 bp, Homo sapiens
tggtaacttcaaagtccctaacacattcgatatttctcctagcttccact

SEQ ID NO: 6803 - DNA, 50 bp, Homo sapiens
actcccaccaaaccccactttgtaatcactggtagtaaagagagatgcag

SEQ ID NO: 6804 - DNA, 50 bp, Homo sapiens
aagagtaagaggcaacagatagagtgtccttggtaataagaagtcagaga

SEQ ID NO: 6805 - DNA, 50 bp, Homo sapiens
gaaattggaaggtgatacttggggaccacaacacgcacatctgggaactg

SEQ ID NO: 6806 - DNA, 50 bp, Homo sapiens
tcatctgtggcatacagaatgtctacaatcttctgcaatacagggtcgtt

SEQ ID NO: 6807 - DNA, 50 bp, Homo sapiens
ggcaagggaacaaacttgagtaaatctagctcttgaagggctcgggaccc

SEQ ID NO: 6808 - DNA, 50 bp, Homo sapiens
actcatttgtctcctcattctcaaaagtcttctgtggtttggcttcagtg

SEQ ID NO: 6809 - DNA, 50 bp, Homo sapiens
tcgatgggccattatccactctgctatcttctgaagagtaattttcacct

SEQ ID NO: 6810 - DNA, 50 bp, Homo sapiens
aaggacggaactcacacatcttctttagacagaaatgtagtctcactgca

SEQ ID NO: 6811 - DNA, 50 bp, Homo sapiens
tataatcccagtccatgagggtgtaaagtgaaatgagctggctggctgga

SEQ ID NO: 6812 - DNA, 50 bp, Homo sapiens
gctctgttctggggttggtccaaagtcaggtggagttccaatgtatgaaa

SEQ ID NO: 6813 - DNA, 50 bp, Homo sapiens
tccctgagatctaggagggcagcatagtatcatttttgtattccggtgct

SEQ ID NO: 6814 - DNA, 50 bp, Homo sapiens
agctgctacaaagaagacatgttttagacaaatactcatgtgtatgggca

SEQ ID NO: 6815 - DNA, 50 bp, Homo sapiens
agggatctgaatacttcgggtgcaaaaattttcctgcagtttagatttgc

SEQ ID NO: 6816 - DNA, 50 bp, Homo sapiens
tatggtttccaatatcgacatggcatcattggttacattagcactgggcc

SEQ ID NO: 6817 - DNA, 50 bp, Homo sapiens
ggcctgggcatagactgtggtgaggtcactagattatcttgttcttcccc

SEQ ID NO: 6818 - DNA, 50 bp, Homo sapiens
gagtcctgatctcagcttcatcaccaacattcctcgccttcagttgaatt

SEQ ID NO: 6819 - DNA, 50 bp, Homo sapiens
ggaggtctttgccaccaatgggagatgagcccaaactttcgatataggtg

SEQ ID NO: 6820 - DNA, 50 bp, Homo sapiens
accagaggtaaacttgagtgtaattgtcagacagacacacttttccacca

SEQ ID NO: 6821 - DNA, 53 bp, Homo sapiens
tgcattttacattagcttccaatatttatggcagtaaccaacagtattatcgt

SEQ ID NO: 6822 - DNA, 50 bp, Homo sapiens
tttccaatgctccttgctccattttaaacttgctgtcctttataagagaa

SEQ ID NO: 6823 - DNA, 50 bp, Homo sapiens
tgttttcacgatagaaataaggaaggtctagagcttctattctttggcca

SEQ ID NO: 6824 - DNA, 50 bp, Homo sapiens
tttcatacaaagccaacagaattcacagccacacactgcacaggtcatgt

SEQ ID NO: 6825 - DNA, 50 bp, Homo sapiens
aggaagctgtgagggtgggttcattagttgcagggatggtagttatgtca

SEQ ID NO: 6826 - DNA, 50 bp, Homo sapiens
gagacaagctggaaggccggacctcagaccggagggggtttatgtcattc

SEQ ID NO: 6827 - DNA, 50 bp, Homo sapiens
ataactagacaaggtctgagcactttgggtggggatggagtgagaaaggc

SEQ ID NO: 6828 - DNA, 50 bp, Homo sapiens
attaagttgggtaacgccagggttttcccagtcacgacgttgtaaaacga

SEQ ID NO: 6829 - DNA, 50 bp, Homo sapiens
gcgttctagctgggccaacagagcaggatttcgtttcagaaaacaaaaca

SEQ ID NO: 6830 - DNA, 50 bp, Homo sapiens
atcatgtctcattaacagagtgaagatggagcaacgtcatccagcttctg

SEQ ID NO: 6831 - DNA, 50 bp, Homo sapiens
tggtcgcgcccgaggtacggttttcatggtagggctgaatggaagatgtg

SEQ ID NO: 6832 - DNA, 50 bp, Homo sapiens
cagaaagataggagtgtgcaatggcaaggaaactcaatttaaagcaaatt

SEQ ID NO: 6833 - DNA, 50 bp, Homo sapiens
ttgcaaattctcatggtttgggttgggtggtggagagcgcgtgtcatctg

SEQ ID NO: 6834 - DNA, 50 bp, Homo sapiens
ttattcagcgtcacgatcagactgttacatttagcaatcaacagcatggg

SEQ ID NO: 6835 - DNA, 50 bp, Homo sapiens
tgtgtgtatgtgtgtaaccaggtctgactatagcttggtctgtctgtgtc

SEQ ID NO: 6836 - DNA, 50 bp, Homo sapiens
agcatttggggttttagctttggtgtcctaaatttcagtgatctttgcca

SEQ ID NO: 6837 - DNA, 50 bp, Homo sapiens
cataaaccagcagctcagcgtttctatagcaagcggtctcgagcacaagc

SEQ ID NO: 6838 - DNA, 50 bp, Homo sapiens
tagtgataggcgtggtggcggcgaaggtcagtaatggggcttttaaccag

SEQ ID NO: 6839 - DNA, 50 bp, Homo sapiens
tactgtagaaagaagaagagcacacatgagacagagaaggaggtggatgc

SEQ ID NO: 6840 - DNA, 50 bp, Homo sapiens
cgaggcggcccggcagggtaccaatttggatgaattcttgatagatttaa

SEQ ID NO: 6841 - DNA, 50 bp, Homo sapiens
ttgggttcagaatagcttcatctactgccgagcaaagtcaatacagcact

SEQ ID NO: 6842 - DNA, 50 bp, Homo sapiens
ggtaacagccatcccaccaccaataatcatctcattgtctttgtccagca

SEQ ID NO: 6843 - DNA, 50 bp, Homo sapiens
gtatgaatagattgccccattccctgccagcctggtagtgacttttccac

SEQ ID NO: 6844 - DNA, 50 bp, Homo sapiens
tataatttctaccaaactaagttttattttgtgcccgctccctgtccctt

SEQ ID NO: 6845 - DNA, 50 bp, Homo sapiens
ctgtaaaattcttttcgggtccatcctggctctcatctccagtgctttga

SEQ ID NO: 6846 - DNA, 56 bp, Homo sapiens
agggttaacaaaagtatggaattcaattctttttatatgctgcagccatgttcctg

SEQ ID NO: 6847 - DNA, 50 bp, Homo sapiens
cccaatctgaagtcagtaaatgaactaatctacaagcgtggttatggcaa

SEQ ID NO: 6848 - DNA, 50 bp, Homo sapiens
ccgaggtactctcttagagaaaggtgattggatgctccggttgcctgtaa

SEQ ID NO: 6849 - DNA, 50 bp, Homo sapiens
gcgggttggaaaatagtcgagaattgacagtccctctcgaagatgctttt

SEQ ID NO: 6850 - DNA, 50 bp, Homo sapiens
ttgagaccccaccaactgcaaaatctgttcctggcattaagctccttctt

SEQ ID NO: 6851 - DNA, 50 bp, Homo sapiens
aatgaaaaactccagctctcagctcacaaatctgtaatttaggtgtctct

SEQ ID NO: 6852 - DNA, 50 bp, Homo sapiens
tcgtcctggttaatctggaagtaacgtaattcgtaactctctttgctgtt

SEQ ID NO: 6853 - DNA, 50 bp, Homo sapiens
tcggttgttaagaactagagcttattcctattccaaatctatcttgcgct

SEQ ID NO: 6854 - DNA, 50 bp, Homo sapiens
agataagaacttcatcctaaagcatccgggccttggcatcttgtccatgc

SEQ ID NO: 6855 - DNA, 50 bp, Homo sapiens
actgatttcatcaagttcgacactggtaacctgtgtatggtgactggagg

SEQ ID NO: 6856 - DNA, 50 bp, Homo sapiens
aatcattggctacctcctccccttttacagtcacaagtccagatgtttgg

SEQ ID NO: 6857 - DNA, 50 bp, Homo sapiens
aataaatcccatacctcccattgaactaccacccaccccgaccaccataa

SEQ ID NO: 6858 - DNA, 50 bp, Homo sapiens
caagacatttccagccaacttcagaatgtagatctttgagccagacagct

SEQ ID NO: 6859 - DNA, 50 bp, Homo sapiens
gaggtactggcctgtgaagccctgaaggcactggcactggtaggaaccag

SEQ ID NO: 6860 - DNA, 50 bp, Homo sapiens
atcttctgtcaaagtcagtcgctgctccaagattgaaacagtctgtgtca

SEQ ID NO: 6861 - DNA, 50 bp, Homo sapiens
tggatggatttccaagtggcctcatatttatcatggtgctttaaatagca

SEQ ID NO: 6862 - DNA, 50 bp, Homo sapiens
ttcagcttagggaaagagagatacattttagattatagagcatcgcctgc

SEQ ID NO: 6863 - DNA, 50 bp, Homo sapiens
atcttcctatgtgcgccagataatgatcaagttcacaggtggtcttactt

SEQ ID NO: 6864 - DNA, 50 bp, Homo sapiens
agtttcttaagtcaaatgacacattagcccacgcaattcccagccccagc

SEQ ID NO: 6865 - DNA, 50 bp, Homo sapiens
ccctcttctgacatgaattaggcataatttagcaatcggttcttcccaaa

SEQ ID NO: 6866 - DNA, 50 bp, Homo sapiens
atacagtgaactggccactggctgtttgctatataaatggtatactgctt

SEQ ID NO: 6867 - DNA, 50 bp, Homo sapiens
aggttacttaaaagcatcattggcgtggtcctctcactaccaaagggcag

SEQ ID NO: 6868 - DNA, 50 bp, Homo sapiens
ctggggtcagcaaagaggggtagcaagtgtgccttagagatgaagaaatg

SEQ ID NO: 6869 - DNA, 50 bp, Homo sapiens
tttagagtacttagaggaggaccaggaaacactgagacagacacgcaggc

SEQ ID NO: 6870 - DNA, 50 bp, Homo sapiens
tgtttgaaaactaccttcatgggagcaatgacaagcacatgtctaggatt

SEQ ID NO: 6871 - DNA, 50 bp, Homo sapiens
tttgtgccaaggtttgggattttgtcttctagagcttcttctctattggt

SEQ ID NO: 6872 - DNA, 50 bp, Homo sapiens
tttttgacgctctctcactggtcttggcatttgatgtttctgttgaagcc

SEQ ID NO: 6873 - DNA, 50 bp, Homo sapiens
cctataatgggggaaagatgctggttagatgtttattttagtgggcttgc

SEQ ID NO: 6874 - DNA, 50 bp, Homo sapiens
ccacaaacacaccctgccacaagacatttagcacagaggaacagatccat

SEQ ID NO: 6875 - DNA, 50 bp, Homo sapiens
gacaccacaactcacctcctctattattagagatcccgagacattacggc

SEQ ID NO: 6876 - DNA, 50 bp, Homo sapiens
tgttacaatttcagcagttgaattcagtgaacactggttgaggagtgcct

SEQ ID NO: 6877 - DNA, 50 bp, Homo sapiens
ccttccgtattctcccaagtattcacaagccctcccttaaaaccctctct

SEQ ID NO: 6878 - DNA, 50 bp, Homo sapiens
acagccatctgggatgagccgcttttcagccaccatgtcttcaaattcat

SEQ ID NO: 6879 - DNA, 50 bp, Homo sapiens
taactgaatacagtctcatcttgccgcgcctggcttacctatctgtggaa

SEQ ID NO: 6880 - DNA, 50 bp, Homo sapiens
aggtactacacaaggtgtcagatggggttgccacaatgactaggacaaga

SEQ ID NO: 6881 - DNA, 50 bp, Homo sapiens; identical to SEQ ID NO: 363

SEQ ID NO: 6882 - DNA, 50 bp, Homo sapiens
gagagctttctccccgccttcagtttctgatggatctagccatgttgaaa

SEQ ID NO: 6883 - DNA, 50 bp, Homo sapiens
taaaactttctgccagggttccagagaaagagtaatttcctttgagtacc

SEQ ID NO: 6884 - DNA, 50 bp, Homo sapiens
cgctcgccgggccaggtaccaaaactttcataataaaaggtaggaaggat

SEQ ID NO: 6885 - DNA, 50 bp, Homo sapiens
tgacttcattgaaggctccatcacccaaagtagatgttaaaaaccttaat

SEQ ID NO: 6886 - DNA, 50 bp, Homo sapiens
tttatgtggaaggcttccctattacctcccagcgaaattcgtagtctttc

SEQ ID NO: 6887 - DNA, 50 bp, Homo sapiens
taaaatgttgccagtggaggaccgaatcaaggttattgctgacctcattt

SEQ ID NO: 6888 - DNA, 50 bp, Homo sapiens
agatatgttctgagccccgcccacacactgcctggttacagggagagaag

SEQ ID NO: 6889 - DNA, 50 bp, Homo sapiens
gaggttccttcatcccagaagaagcaacaggatttccagatcagggcaac

SEQ ID NO: 6890 - DNA, 50 bp, Homo sapiens
ctggtctgtgtcgttggctttatgacaggaagtgcctgtgggttatctta

SEQ ID NO: 6891 - DNA, 50 bp, Homo sapiens
cccaacgcttgtgtgcgtatgtatgtgtgtatttaacatcctgttcccat

SEQ ID NO: 6892 - DNA, 50 bp, Homo sapiens
gcataaaggcagccatttccattctctacattctctagtgatagcagagg

SEQ ID NO: 6893 - DNA, 50 bp, Homo sapiens
cgttacgcaatggagaagtccccttgaggctgaataatcacatctgtatc

SEQ ID NO: 6894 - DNA, 50 bp, Homo sapiens
aggccaaatcaccgcacagttgaattgctgattctaattggtaacaataa

SEQ ID NO: 6895 - DNA, 50 bp, Homo sapiens
ttgtagtgtaattgtgtgatacgcaaacctttagttaacccaagtgatga

SEQ ID NO: 6896 - DNA, 50 bp, Homo sapiens
ccttgttgccgtgggtatatgcatgatcttaccttttgtttgactatgaa

SEQ ID NO: 6897 - DNA, 50 bp, Homo sapiens
aaatgatatgttaagcacccaaatcttcacatggaggggaagggggtggg

SEQ ID NO: 6898 - DNA, 50 bp, Homo sapiens
ggccaaagctgtttattatgagatctttgagtggaatcagcatgtctccc

SEQ ID NO: 6899 - DNA, 50 bp, Homo sapiens
ttaacagcattgaaggtgaaacagcacaatgtcccattccaaatttattt

SEQ ID NO: 6900 - DNA, 50 bp, Homo sapiens
aggtacgaaaatacattctggcatcacacccctgaacccaagactgttct

SEQ ID NO: 6901 - DNA, 50 bp, Homo sapiens
gaactacctactggcagttgggttcagggagatgggattgacttcgcctt

SEQ ID NO: 6902 - DNA, 50 bp, Homo sapiens
agagctaatatacagagtacctgacacactacctcaccaacagtttaact

SEQ ID NO: 6903 - DNA, 50 bp, Homo sapiens
gcccaggcaacaagaatacttttatctttgatccgttctgtttatccagt

SEQ ID NO: 6904 - DNA, 50 bp, Homo sapiens
ctgagggtagactgtgggcaaagaggacaactctccctcccctaagggac

SEQ ID NO: 6905 - DNA, 50 bp, Homo sapiens
tgcccagacctatttccttaggacagtattctaaagttcagtagtccagt

SEQ ID NO: 6906 - DNA, 50 bp, Homo sapiens
gccctgtcccttgagaggctcacagcgatggaggccacttttgttgtttg

SEQ ID NO: 6907 - DNA, 50 bp, Homo sapiens
accaaaaagggctacattaccaccactgtatcataaaagccagccacctt

SEQ ID NO: 6908 - DNA, 50 bp, Homo sapiens
agctgacgattttctatcccggcctatagtgcatgtatggcaattgagca

SEQ ID NO: 6909 - DNA, 50 bp, Homo sapiens
ccccaaaacaaacaaaataaaccacaccagatatcagtcacatccttgaa

SEQ ID NO: 6910 - DNA, 50 bp, Homo sapiens
agtctgttattgcctgattttgtccccaccttgttcaaatttccaaagct

SEQ ID NO: 6911 - DNA, 50 bp, Homo sapiens
ctcacagccgaagctctgatcctttgttctcaggaaacactcaggaagtg

SEQ ID NO: 6912 - DNA, 50 bp, Homo sapiens
agagaaaatgagagacagacagtgagtgggaaagtcagcgaaaaggaaaa

SEQ ID NO: 6913 - DNA, 50 bp, Homo sapiens
tccttgagtttatacaccgtgctatgagtgatgacagccaattcccatgc

SEQ ID NO: 6914 - DNA, 50 bp, Homo sapiens
tcgcttcaggggtcagccaaaagatagacagccaggtaacttgagtggac

SEQ ID NO: 6915 - DNA, 50 bp, Homo sapiens
ggacagtaccaaacactcccctcctcccctctgcctctttgcttacttag

SEQ ID NO: 6916 - DNA, 50 bp, Homo sapiens
gaccaaatactgaacttccaccctgcataataatcatgaacaccgcacca

SEQ ID NO: 6917 - DNA, 50 bp, Homo sapiens
aggtgagcagtgcctcagatacctgcaaaacctttctgcacaaatgtgct

SEQ ID NO: 6918 - DNA, 50 bp, Homo sapiens
cagatccaatgagggtcccatctcttcccacttcaatcccgtgttgttct

SEQ ID NO: 6919 - DNA, 50 bp, Homo sapiens
ccaaccaaaccatcaaacagcagggagctagtgaagaggtctattgttcc

SEQ ID NO: 6920 - DNA, 50 bp, Homo sapiens
acatcgcctaaaaccgtgcatcgtaaacatttacctcaaagtcatcctct

SEQ ID NO: 6921 - DNA, 50 bp, Homo sapiens
ttttcactcctctcagagtctactccacctctcctcactccccaggacac

SEQ ID NO: 6922 - DNA, 50 bp, Homo sapiens
agatctgtgttcgtctctaggtaataggaaacacaatccagacatgatct

SEQ ID NO: 6923 - DNA, 50 bp, Homo sapiens
ttcatgaactcggagaggtccatggtgcactcccgctcgtcctgggacac

SEQ ID NO: 6924 - DNA, 50 bp, Homo sapiens
ctggcaatattaacttgggttctgtttcatctctggctataagccataca

SEQ ID NO: 6925 - DNA, 50 bp, Homo sapiens
tgccattcttttgttgaacctgtaaaggtaaggcccagattctgaaacct

SEQ ID NO: 6926 - DNA, 50 bp, Homo sapiens
taaagcacttatgagaatgctgcatttgtacatgagctacgcctcatctt

SEQ ID NO: 6927 - DNA, 50 bp, Homo sapiens
gcacccacctcctcagttcagacaagcccagcacccaaataccactatct

SEQ ID NO: 6928 - DNA, 50 bp, Homo sapiens
agcgcatgagtgactcccatctatatatgtcagtcgtctctggtgcaagg

SEQ ID NO: 6929 - DNA, 50 bp, Homo sapiens
gaaacagtggcccgggtcgtagtgcgctgtccagatcttcacgctacacc

SEQ ID NO: 6930 - DNA, 50 bp, Homo sapiens
agtgcattcacactgatgataaacgatagtagcttcacaggtttgcttct

SEQ ID NO: 6931 - DNA, 50 bp, Homo sapiens
gcttcaaaattccttacccccaacctctggcaccccaaattgtatcacta

SEQ ID NO: 6932 - DNA, 50 bp, Homo sapiens
gaggaagggctggctcttactccccacaagaggtgttccttaggccacac

SEQ ID NO: 6933 - DNA, 50 bp, Homo sapiens
ccaatctaatttaaaccctcataacaggacataagcttgcgcccgcatct

SEQ ID NO: 6934 - DNA, 50 bp, Homo sapiens
tgctcaatgttttgcactgattttattcaatgttttgaagggcgttatga

SEQ ID NO: 6935 - DNA, 50 bp, Homo sapiens
tgctaacaacagcttctcggtatgttaatattctgctaactcctttctca

SEQ ID NO: 6936 - DNA, 50 bp, Homo sapiens
ggaggaatggctgtgcccgtcccctccacttaagcgacctgagtctccag

SEQ ID NO: 6937 - DNA, 50 bp, Homo sapiens
acacacacttaagagtacagatgagagccaaaaataagtggcaggtcttt

SEQ ID NO: 6938 - DNA, 50 bp, Homo sapiens
ttttgtgactgtgcatgcttgaaaagaataagttttctgcagctgtgtct

SEQ ID NO: 6939 - DNA, 50 bp, Homo sapiens
cttgtctgtggcgtggcacacagtaggtgctcggtttgtgttgttgaatg

SEQ ID NO: 6940 - DNA, 50 bp, Homo sapiens
gaattctgaatacatgttggactgtgtttctttgacctgtgtttcctagg

SEQ ID NO: 6941 - DNA, 50 bp, Homo sapiens
tgagtccttggcctcagcttctaatctcaaacctaaaatagattgcgttt

SEQ ID NO: 6942 - DNA, 50 bp, Homo sapiens
tcttctcgtctttgctattaaatttcttcacggaccatgcatctggagga

SEQ ID NO: 6943 - DNA, 50 bp, Homo sapiens
ccagagactcctaagcagaatcaaggatgtgtggcataagcatgagagcc

SEQ ID NO: 6944 - DNA, 50 bp, Homo sapiens
cccataaagaggaataagctactgtcctcagctcttgttagctcaggctt

SEQ ID NO: 6945 - DNA, 50 bp, Homo sapiens
agagtttgtaacacaatccagtccacatgcttatccaatcccatcatcca

SEQ ID NO: 6946 - DNA, 50 bp, Homo sapiens
agctcaaaatatggcaaagtgatgatttcgtgttaatcctagaaacagca

SEQ ID NO: 6947 - DNA, 50 bp, Homo sapiens
tgggtctgctttcacatgaaagtgctacgaattctcttttgtgctgagcc

SEQ ID NO: 6948 - DNA, 50 bp, Homo sapiens
ggatgagcccactcacagcaccagatttgtactgaaagtaccttaatatc

SEQ ID NO: 6949 - DNA, 50 bp, Homo sapiens
aacccaaatccaaatgccaggatagaagaatttgtttatgagaaactgga

SEQ ID NO: 6950 - DNA, 50 bp, Homo sapiens
cgctttttgatctgattactatttcacacaggttacagctatgaccatga

SEQ ID NO: 6951 - DNA, 50 bp, Homo sapiens
ctgccgctaattcactagtaatttcgatcgtccgccctccaggtacatat

SEQ ID NO: 6952 - DNA, 50 bp, Homo sapiens
aggcgtgctattaattatcccataccctccttacagaaattacactcgca

SEQ ID NO: 6953 - DNA, 50 bp, Homo sapiens
gggagaagttctttaaactaagggtacaaaatgaattgaatgctgggggc

SEQ ID NO: 6954 - DNA, 50 bp, Homo sapiens
attagcgtgttcgcgcccgaggtacaccaaaaccttcagaaagcaaagtt

SEQ ID NO: 6955 - DNA, 50 bp, Homo sapiens
aagatatgaaatatgcctacccgcagagcttggcacaaagtggagtcaat

SEQ ID NO: 6956 - DNA, 50 bp, Homo sapiens
gtacagagatcggatcacacaagcccggagacagtgcagcttctccactg

SEQ ID NO: 6957 - DNA, 50 bp, Homo sapiens
aatgcacttgtgataaactgacagcagggttagacattactttcaaagct

SEQ ID NO: 6958 - DNA, 50 bp, Homo sapiens
ccactgctcaggaaactgcctgttcggtgctcctccaattcaattaagct

SEQ ID NO: 6959 - DNA, 50 bp, Homo sapiens
agtgctggtataactgcagaaagagatagagaagagagatcagtgagagc

SEQ ID NO: 6960 - DNA, 50 bp, Homo sapiens
aagtcaggacctttgcacttgccccgcctctgccttcacagctcttctca

SEQ ID NO: 6961 - DNA, 50 bp, Homo sapiens
taatcagggaagagcttgagatcattagcaactgaactgaacagggagtt

SEQ ID NO: 6962 - DNA, 50 bp, Homo sapiens
ctgggtcacgtcgcccaccaatggtatctgtgtggttaggcattaggctg

SEQ ID NO: 6963 - DNA, 50 bp, Homo sapiens
ggtggtaggtgagtgggtattgcgggctagtatccgagcaaaagatggtg

SEQ ID NO: 6964 - DNA, 50 bp, Homo sapiens
cagccctgctatctctggttgttcatgtacttctgtaaggtggagaccct

SEQ ID NO: 6965 - DNA, 50 bp, Homo sapiens
gaaggtgagaaacccgagagacaccaactatgatttttacttttcctggt

SEQ ID NO: 6966 - DNA, 50 bp, Homo sapiens
accacccctcccttccctcctttaactcatctcgaatctctctcatacat

SEQ ID NO: 6967 - DNA, 50 bp, Homo sapiens
ctcttatcctgctctgccctggaacttgaaccccagtgccaatactcatg

SEQ ID NO: 6968 - DNA, 50 bp, Homo sapiens
cgacctaatctctgtccccagaaggcagaccaggactccagccccaggag

SEQ ID NO: 6969 - DNA, 50 bp, Homo sapiens
gccaaatctttgtcctgtacaaagtacagatgtttttgactgaagttcca

SEQ ID NO: 6970 - DNA, 50 bp, Homo sapiens
gccacagtgaataaatacaaggcaaggctcataggtaaaacaagttctat

SEQ ID NO: 6971 - DNA, 50 bp, Homo sapiens; identical to SEQ ID NO: 5545

SEQ ID NO: 6972 - DNA, 50 bp, Homo sapiens
aaacccacccatcatttgccctgactacccatctcccgattaattcaccc

SEQ ID NO: 6973 - DNA, 50 bp, Homo sapiens
agggaacagagccaggatttaaactctaacaatttgtctccacaattgca

SEQ ID NO: 6974 - DNA, 50 bp, Homo sapiens
ctcctggcacgacagaactagtagtttccatgtcttgaggacataggtcc

SEQ ID NO: 6975 - DNA, 50 bp, Homo sapiens
tcgaacctgttccaggtatgctgatagatgtcggtagggcatccttaatt

SEQ ID NO: 6976 - DNA, 50 bp, Homo sapiens
gaggtactataaaccagatgcccaaaacacctgccctcctgggttggccg

SEQ ID NO: 6977 - DNA, 50 bp, Homo sapiens
acattcatctgtttccactgaggtctgagtcttcaagttttcaccccagc

SEQ ID NO: 6978 - DNA, 50 bp, Homo sapiens
ttagcccttttctgcgctaattagaatttcaagcgtcacagagcctgggg

SEQ ID NO: 6979 - DNA, 50 bp, Homo sapiens
ttcaacgaggtgaaccagtgtgatgtctgtggggaaaacacgtagtcagg

SEQ ID NO: 6980 - DNA, 53 bp, Homo sapiens
ggaaaaaagaaatttcctgagatttccagtgtatacagaagtgtctttccatt

SEQ ID NO: 6981 - DNA, 50 bp, Homo sapiens
gagttcacgtggggtggccctcctcagtgctcttagggtactgtactgtc

SEQ ID NO: 6982 - DNA, 50 bp, Homo sapiens
ccaccttcgaggtcccttccggcctaagatgcctgaaatctccaaggaaa

SEQ ID NO: 6983 - DNA, 50 bp, Homo sapiens
acaaggcaaagcttaaagaaacactaaacgaatgagtgaaagaagcggag

SEQ ID NO: 6984 - DNA, 50 bp, Homo sapiens
ttctcaataacaaacccagggctttcataaatgcatgatcaaaatgtgga

SEQ ID NO: 6985 - DNA, 50 bp, Homo sapiens
acagaaaatagggtgtatatcagcattacgctgattcagcagaagatagc

SEQ ID NO: 6986 - DNA, 50 bp, Homo sapiens
tctcgactgacacccactataaattccctgggttgaaaaacttttctttt

SEQ ID NO: 6987 - DNA, 50 bp, Homo sapiens
tccaaacccctccattacaatctaacacacttccccctacatcgtctcct

SEQ ID NO: 6988 - DNA, 50 bp, Homo sapiens
gcatttattttcttctacagagaacctggcggctgggtctgggaaagagc

SEQ ID NO: 6989 - DNA, 50 bp, Homo sapiens
acccacaattagtgagagtgcccttgagcttgagattcccattcctcctt

SEQ ID NO: 6990 - DNA, 50 bp, Homo sapiens
tggatataaagtgtgtgttctgacagaaaatggggagaaggtggctattt

SEQ ID NO: 6991 - DNA, 50 bp, Homo sapiens
gccagaaaatcctggtttccctggtgtcccctccaatctcttttaccaaa

SEQ ID NO: 6992 - DNA, 50 bp, Homo sapiens
ccattgtcgcccggagctggaaagatagtttagagaatgccttagcactt

SEQ ID NO: 6993 - DNA, 50 bp, Homo sapiens
cagcacccagtacaggtatgcaggaaggactcgcttgacttagagagtgg

SEQ ID NO: 6994 - DNA, 50 bp, Homo sapiens
aacacaccagaaggaaaagacacagacagggaatgaagcctgcaaagtcc

SEQ ID NO: 6995 - DNA, 50 bp, Homo sapiens
gtaactcagtgcccccaaagattcatagtcagcaggattggccagcaaat

SEQ ID NO: 6996 - DNA, 50 bp, Homo sapiens
cgccccaaatataaaatctcaataccagttccttttccccagtaccccag

SEQ ID NO: 6997 - DNA, 50 bp, Homo sapiens
agtcacaggatgttctctgcacctcatctgcaactctgagccttactcaa

SEQ ID NO: 6998 - DNA, 50 bp, Homo sapiens
gttagagccctcgtgccctgcttcttcagctaccatttctctctgtgacc

SEQ ID NO: 6999 - DNA, 50 bp, Homo sapiens
ccaccacaaccacacacacaaaaagtcaacccacacgaatataccggaaa

SEQ ID NO: 7000 - DNA, 50 bp, Homo sapiens
cagttgggctgttagtagtctgtcacacaggtgagaggagcaagagatcc

SEQ ID NO: 7001 - DNA, 50 bp, Homo sapiens
aatctattatcaggcatttaatcactgagcactcttctgtcccacactgt

SEQ ID NO: 7002 - DNA, 50 bp, Homo sapiens
agaggagtgacggtgaatggtactgaaagcggttgtaaattgcgagagag

SEQ ID NO: 7003 - DNA, 50 bp, Homo sapiens
tctccttgttctgattctctccccatctacaacaactccactccccaaag

SEQ ID NO: 7004 - DNA, 50 bp, Homo sapiens
cacctaaccaagcgggttgggctgatgaccgatgaccgtaagcagtaagg

SEQ ID NO: 7005 - DNA, 50 bp, Homo sapiens
acctcttctttagcaacactaaccactccacactggggaaattatactct

SEQ ID NO: 7006 - DNA, 50 bp, Homo sapiens
actaccgcacaacagaacacatgaccaggtgagtgcagacacgacatcag

SEQ ID NO: 7007 - DNA, 50 bp, Homo sapiens
cagttttactcctggtcatctcttgtgagtgtggattcttctctgcccct

SEQ ID NO: 7008 - DNA, 50 bp, Homo sapiens
ttttattttggctgaagtttgggtatggctgcttgttggcctctgctggg

SEQ ID NO: 7009 - DNA, 50 bp, Homo sapiens
acagcttataaagcactttctcatgcacttcttctcgccgtatttgcaca

SEQ ID NO: 7010 - DNA, 50 bp, Homo sapiens
ggggctcaaacctgtgacttactgctaactaacatcaaaggaaaagctgg

SEQ ID NO: 7011 - DNA, 50 bp, Homo sapiens
atgatcattgatagatattctaagagcatgcaggaatgaggatgcgtgcc

SEQ ID NO: 7012 - DNA, 50 bp, Homo sapiens
gacaacaaacctgcttgcttggttacccacagcgcactgagtatagaagt

SEQ ID NO: 7013 - DNA, 50 bp, Homo sapiens
tcttcaattattcatgctctaaggcagtgtctgtcttcccaccatcccgc

SEQ ID NO: 7014 - DNA, 52 bp, Homo sapiens
tgagtatttttaaaatcccctgtttggatgcttccagctaaatagtctacct

SEQ ID NO: 7015 - DNA, 52 bp, Homo sapiens
tgggtttactcagatcttctccttcttaagtgagagttttaacctacatttt

SEQ ID NO: 7016 - DNA, 50 bp, Homo sapiens
gtccagagctagaagaaccaagtcttcctttcttcattcattgttcaggt

SEQ ID NO: 7017 - DNA, 50 bp, Homo sapiens
cttcttcttaggatctggagggaggggagtgttagagcttgtgagccatg

SEQ ID NO: 7018 - DNA, 50 bp, Homo sapiens
ctgaacgaaccagttcttttggactaccagttcttgaagtgaagctcaga

SEQ ID NO: 7019 - DNA, 50 bp, Homo sapiens
aacaaaagcactgacaagctcatatgaacaggctaaaaagtgagtgaagt

SEQ ID NO: 7020 - DNA, 50 bp, Homo sapiens
ttctctttctatatctagctaaattgcctgtgcgcctcccatcctcctca

SEQ ID NO: 7021 - DNA, 50 bp, Homo sapiens
acacacttgataaattagaccgatgcaaaccgcaagaatccaaatcagct

SEQ ID NO: 7022 - DNA, 50 bp, Homo sapiens
atagtaggtgagccagtagtgtgaatgcttgtcaagcttccaaggatgga

SEQ ID NO: 7023 - DNA, 50 bp, Homo sapiens
aaccaccacccagcttcctggtacaagcagggactctggctacagtgcta

SEQ ID NO: 7024 - DNA, 50 bp, Homo sapiens
tttcctcccctccctccccaatccacaaaacacgtaattctgactatcca

SEQ ID NO: 7025 - DNA, 50 bp, Homo sapiens
caacattcacaaaactggtccccgaattagtgagaaggttccaggagtgc

SEQ ID NO: 7026 - DNA, 50 bp, Homo sapiens
gagagattatagcacagtctcccagggctcagtcaggtcatccgcagcaa

SEQ ID NO: 7027 - DNA, 50 bp, Homo sapiens
ttcaatgctttgtcctcccctcgcagatgtttagaacagatcctccttct

SEQ ID NO: 7028 - DNA, 50 bp, Homo sapiens
tccctctctcagggctgggaaagaaaggttcatcttcactcagatgcaag

SEQ ID NO: 7029 - DNA, 50 bp, Homo sapiens
ttctgttggtctgccagctcatccattcatccatcacctgccagctagac

SEQ ID NO: 7030 - DNA, 50 bp, Homo sapiens
acacagttttggctcccttattttccccgtactcgaaacatttccatgca

SEQ ID NO: 7031 - DNA, 50 bp, Homo sapiens
accaaatcgcaaaaatacagaatgcctgtaaattgagtcacaccttaaaa

SEQ ID NO: 7032 - DNA, 50 bp, Homo sapiens
gagtccataaatctgcatttcatgtagttgtaagactttctcccaaaggt

SEQ ID NO: 7033 - DNA, 50 bp, Homo sapiens
tccatttgagttttcttcccatctctcacagttgattgttctgtcccttc

SEQ ID NO: 7034 - DNA, 50 bp, Homo sapiens
aaaattcagccctcctggattcacgtgcccaatgaaagtccccaaactag

SEQ ID NO: 7035 - DNA, 50 bp, Homo sapiens
tttaacaggaaaagcccaaaattatttttatgctgtctacaatctgggcc

SEQ ID NO: 7036 - DNA, 50 bp, Homo sapiens
agttgcactggttgttcttggctgcggtgcttctcacacaagaagcccag

SEQ ID NO: 7037 - DNA, 50 bp, Homo sapiens
tttcctttttcccttgtcccttggcttcccccatcaccgaatcccccttc

SEQ ID NO: 7038 - DNA, 50 bp, Homo sapiens
ctcccacgcctggccgtagtccagagcttcttctttttcatggttgggtt

SEQ ID NO: 7039 - DNA, 50 bp, Homo sapiens
gccagtgtacgttgccaggcatttcatgtaagagaaaactcaaatagcca

SEQ ID NO: 7040 - DNA, 50 bp, Homo sapiens
ccgtcttcttttgggtgtttcctcctagtttcggcggaaatcagagttca

SEQ ID NO: 7041 - DNA, 50 bp, Homo sapiens
atgaaccctcacctgctctgcagtgcagttttgattttagtcccagcaaa

SEQ ID NO: 7042 - DNA, 58 bp, Homo sapiens
agatatagatggtaaaatgtgatgcaatgtaaaaaaatggtaatacacacactctcca

SEQ ID NO: 7043 - DNA, 50 bp, Homo sapiens
tgagtgggcttctcttatggtacagtctcttctctatgaggggcttcaaa

SEQ ID NO: 7044 - DNA, 50 bp, Homo sapiens
tgggcttccaaatggtacaatggagtaatcaagctcatggactgagagtt

SEQ ID NO: 7045 - DNA, 50 bp, Homo sapiens
cttgaagctacttgtccctttctgtgccagaccacttaatggctacccac

SEQ ID NO: 7046 - DNA, 50 bp, Homo sapiens
ttcccagggcgctccatctacagccttactgtgactccactcagcaccag

SEQ ID NO: 7047 - DNA, 50 bp, Homo sapiens
attccccctaagctcctgtcccccgccatgcacgactggtcacatcaaaa

SEQ ID NO: 7048 - DNA, 50 bp, Homo sapiens
aagacacacccctcctgtttaataaaagttgtcccctcgacatgcataat

SEQ ID NO: 7049 - DNA, 50 bp, Homo sapiens
cctggttacaataatgaaactgtcgtggagtaaagagggaaacatgacca

SEQ ID NO: 7050 - DNA, 50 bp, Homo sapiens
agaacccacacactgggagacaataactgccattcatataaccaacagaa

SEQ ID NO: 7051 - DNA, 50 bp, Homo sapiens
cgccactgcttaaagattacagacaattcccaggtaaagttgccaggact

SEQ ID NO: 7052 - DNA, 50 bp, Homo sapiens
acaatgatgtttgaaacgcactctgaatctgtgaaagctagataagtcct

SEQ ID NO: 7053 - DNA, 50 bp, Homo sapiens
gccttcctcctcctccctcttgggcctatgtcctagataagcctgttaaa

SEQ ID NO: 7054 - DNA, 50 bp, Homo sapiens
tgtcaagatgacagatcttaatccagagtggaggctcgttcggcctggag

SEQ ID NO: 7055 - DNA, 50 bp, Homo sapiens
tttatgtttcagcctctttctctcccgttgagtcctgccacaagtcctgc

SEQ ID NO: 7056 - DNA, 50 bp, Homo sapiens
attgtccaggtgacttgacacttgcctaccggaaaagttgggatgttctt

SEQ ID NO: 7057 - DNA, 50 bp, Homo sapiens
taaaatatgccctaatttaaagggcgcagggtcccacaacaagccacaga

SEQ ID NO: 7058 - DNA, 50 bp, Homo sapiens
aaatctcttctcacgttctgtttgtcatttaatcaccaggtttttagcgc

SEQ ID NO: 7059 - DNA, 50 bp, Homo sapiens
gctactgatgggtggccctttattcttgtctttatttgttgtgtgcagga

SEQ ID NO: 7060 - DNA, 50 bp, Homo sapiens
aaaaattggtagctgcccccatgtggtatgatgtttaatttgaacaacat

SEQ ID NO: 7061 - DNA, 50 bp, Homo sapiens
acccggcacgtctcctcaaccccttaattcttttccagcttttcatatta

SEQ ID NO: 7062 - DNA, 50 bp, Homo sapiens
ctcaagagggcatagacattccacacgaggactgcattcgtcagggtaac

SEQ ID NO: 7063 - DNA, 50 bp, Homo sapiens
aacaaatacccaattaactgtattcccctttcccctatgactgctggtgt

SEQ ID NO: 7064 - DNA, 50 bp, Homo sapiens
ccgttgtccgaaagcttgcttccaactaaagaccagagatgggagggagt

SEQ ID NO: 7065 - DNA, 50 bp, Homo sapiens
tttagcccaaagaagactttcgcataaattctgccgtaacccttgttgga

SEQ ID NO: 7066 - DNA, 50 bp, Homo sapiens
caaagcagcaaatacagagcacacaacaatccttggcctgagcagaacaa

SEQ ID NO: 7067 - DNA, 50 bp, Homo sapiens
atatgaagatggattggatgaggactgacaaaacgaagacatgccgggcc

SEQ ID NO: 7068 - DNA, 50 bp, Homo sapiens
atgcctagtcagtcagtatttcttcttgctgcaggtgtctaaaaacccac

SEQ ID NO: 7069 - DNA, 50 bp, Homo sapiens
ccttcgcattcccccatccatgctccaagataatagatttttctttaaaa

SEQ ID NO: 7070 - DNA, 50 bp, Homo sapiens
ggggaacactttggtttgaaagcacagagcagtttgccatgtttcttctg

SEQ ID NO: 7071 - DNA, 50 bp, Homo sapiens
actgaatggtcgaaatcacatatgcaccacacatactgatcttaagtaac

SEQ ID NO: 7072 - DNA, 50 bp, Homo sapiens
cgaggtacagcaaagcgacccttggtgtcatagatcagacggaaattctc

SEQ ID NO: 7073 - DNA, 50 bp, Homo sapiens
tacagaagagcagagaccaaccttctcaaagttggtgagtattaacccag

SEQ ID NO: 7074 - DNA, 50 bp, Homo sapiens
ccagatttgctgatgtgttaggtagttgtggcacactcacctgtctttcc

SEQ ID NO: 7075 - DNA, 50 bp, Homo sapiens; identical to SEQ ID NO: 379

SEQ ID NO: 7076 - DNA, 50 bp, Homo sapiens
ttgaacattcgcaaagtaacatctctcactcccaacaccacagcttatcg

SEQ ID NO: 7077 - DNA, 50 bp, Homo sapiens
agtaaccaccaaagcatagttttagaagggctttcgcaaacctagccttt

SEQ ID NO: 7078 - DNA, 50 bp, Homo sapiens
tcttgcttgttcttctcgtttttgttttatcttccgcccggcagggtcag

SEQ ID NO: 7079 - DNA, 50 bp, Homo sapiens
gctctgaaacccctggaactcttgagcctaaaatgtatttttacaatctt

SEQ ID NO: 7080 - DNA, 50 bp, Homo sapiens
atctttgatgtgaagccctttaaaaataaacgtgaaggtgccagcttgca

SEQ ID NO: 7081 - DNA, 50 bp, Homo sapiens
acccagcctgatgttcatcttttccccctcttcattttccttctttgttt

SEQ ID NO: 7082 - DNA, 50 bp, Homo sapiens
agaaagactaacaccagaaatcatgctgcaacaccagaacatcctttgga

SEQ ID NO: 7083 - DNA, 50 bp, Homo sapiens
tcacaaaatatggctcaaggagtataaatcccctctcacgcacccacaaa

SEQ ID NO: 7084 - DNA, 50 bp, Homo sapiens
actaaccaaccaatgagaatactacttacctccacccatgctgtgaaccc

SEQ ID NO: 7085 - DNA, 50 bp, Homo sapiens
tgaccgcctcaaagaccaaaaggactctactccatattcttctcactgtc

SEQ ID NO: 7086 - DNA, 50 bp, Homo sapiens
gaatgaccacctgacgcattcagagctcaccttcttgttcttcagctgtt

SEQ ID NO: 7087 - DNA, 50 bp, Homo sapiens
ttggtagaaaccacccaaccataaaattcccaagcctgtactggtcagcc

SEQ ID NO: 7088 - DNA, 50 bp, Homo sapiens
cataagttgggtgaagaaatggtggttttaatcagtaatatagctccccc

SEQ ID NO: 7089 - DNA, 50 bp, Homo sapiens
ttctcatctcaatatcccccagagccccagtacctcataatacaagactt

SEQ ID NO: 7090 - DNA, 50 bp, Homo sapiens; identical to SEQ ID NO: 383

SEQ ID NO: 7091 - DNA, 50 bp, Homo sapiens
tacccaaagtctattcgtaagtgcatcttttctattagactggaagctcc

SEQ ID NO: 7092 - DNA, 50 bp, Homo sapiens
gatggttcagcaactgaggagctcagggtgacgggtccacagagcacaga

SEQ ID NO: 7093 - DNA, 50 bp, Homo sapiens
agaaattagaagatgactaccatttgctaaagtctatccacatgccagca

SEQ ID NO: 7094 - DNA, 50 bp, Homo sapiens
ccccctcgaccccctcacaccctttccagagaggccttaagattcccatt

SEQ ID NO: 7095 - DNA, 50 bp, Homo sapiens
tgtaaggtttcataaatttagagaccctagccagtcagtgacaatatgca

SEQ ID NO: 7096 - DNA, 52 bp, Homo sapiens
gagttgcttattccagtctctctaagatatatctccctttttagttgctgac

SEQ ID NO: 7097 - DNA, 50 bp, Homo sapiens
tggtgtaatgaacatgccgtattgcctttatggccagtttgagtccttcc

SEQ ID NO: 7098 - DNA, 50 bp, Homo sapiens
agggaaccccaaagagttaaaaccaggaccactatttcatagtcaacaaa

SEQ ID NO: 7099 - DNA, 50 bp, Homo sapiens
gtggtaaatgagagcattacagaccacccacatcagcctaaaatataatt

SEQ ID NO: 7100 - DNA, 50 bp, Homo sapiens
ccaccaaacccaacaggccgggacaaatgcaataccatacagaaacacag

SEQ ID NO: 7101 - DNA, 50 bp, Homo sapiens
ggccaaactttcttactctgccatttgttcaatgtcctaatgagcatgaa

SEQ ID NO: 7102 - DNA, 50 bp, Homo sapiens
atcaatcgggccaatccgaagtcagcaatcttgcatatgagtccattccc

SEQ ID NO: 7103 - DNA, 50 bp, Homo sapiens
tatttttaacaaaatcacacggaaggatttccttcccgtcccatgtgttg

SEQ ID NO: 7104 - DNA, 50 bp, Homo sapiens
cagatagtggtatttgggtgctgggcttgtctgacctgaggaggtggctg

SEQ ID NO: 7105 - DNA, 50 bp, Homo sapiens
aactccatagagaaagactacgaatttcgctgggaggtaatagggaagcc

SEQ ID NO: 7106 - DNA, 50 bp, Homo sapiens
gcatttaggaaagacaggtgagtgtgccacaactacctaacacatcagca

SEQ ID NO: 7107 - DNA, 50 bp, Homo sapiens
ttactttgtcttctctcaccatcctaaaacgttgttttgctgagcatgaa

SEQ ID NO: 7108 - DNA, 50 bp, Homo sapiens
ccccagacgaaaataccaaatgcatggagagctcccgtgagtggttaata

SEQ ID NO: 7109 - DNA, 50 bp, Homo sapiens
gcctaagtttccagaagactttgacgatggagagcatgcaaagcaggtaa

SEQ ID NO: 7110 - DNA, 50 bp, Homo sapiens
ttttgcagttcaaggattggtgggaaacgtttgtatgtgttggggtgggg

SEQ ID NO: 7111 - DNA, 50 bp, Homo sapiens
aatagatttccatttcttccttcgagttagttgggtattgggaccttgaa

SEQ ID NO: 7112 - DNA, 50 bp, Homo sapiens
cgacggtgttctggagtttcgatgagacatgtaagtaagagttctgtgca

SEQ ID NO: 7113 - DNA, 50 bp, Homo sapiens
atattcagcagtggctgtgaaattggatttgaattaccgggatacatgca

SEQ ID NO: 7114 - DNA, 50 bp, Homo sapiens
actggttttcattctagtgtcccccacccgtctagtttcattttcctgta

SEQ ID NO: 7115 - DNA, 50 bp, Homo sapiens
ttgggagtcaccaggttaaagcaaagcctcagtcactgaaagcagaaact

SEQ ID NO: 7116 - DNA, 50 bp, Homo sapiens
tcctgtgctccagaattagtgattgctttggtgcttaacttgaagtggga

SEQ ID NO: 7117 - DNA, 50 bp, Homo sapiens
catctgctctgcttcctcacacactagaaacaccactgcccccatccatg

SEQ ID NO: 7118 - DNA, 50 bp, Homo sapiens
tctgtgatttatagactgttttcaggaaacgatcttcccatctgtggtga

SEQ ID NO: 7119 - DNA, 50 bp, Homo sapiens
tcatttcaggtctaataaacacactaacctcggcagcactggagcgtctg

SEQ ID NO: 7120 - DNA, 50 bp, Homo sapiens
agcttaggatatctattagtgttcactgttcgggcaagaggcctaaaggg

SEQ ID NO: 7121 - DNA, 50 bp, Homo sapiens
tgggaacacactggcccattatatagagaaaaataaaacatgatccccat

SEQ ID NO: 7122 - DNA, 50 bp, Homo sapiens
ttgcttgatttcccaaaccactacctgaaggtggcttatggtctacagct

SEQ ID NO: 7123 - DNA, 50 bp, Homo sapiens
ttccaccacttcaagactgggggcaggtagagaagacaagcataagtaca

SEQ ID NO: 7124 - DNA, 50 bp, Homo sapiens
ttcttctctgcccctaacagaatgttcttctcttgcttcccacaccctcc

SEQ ID NO: 7125 - DNA, 50 bp, Homo sapiens
cagcacatcttctggtttacaagttgggtaactatgaaagctggagatgc

SEQ ID NO: 7126 - DNA, 50 bp, Homo sapiens
tatctaaattctacctttagcatccaactagctaccgtctggcactggcc

SEQ ID NO: 7127 - DNA, 50 bp, Homo sapiens
tccaatgctcaagtcactctgagtctttgctggtgtcaacctacaatgcc

SEQ ID NO: 7128 - DNA, 50 bp, Homo sapiens
acctcactatagtagccattaggtaaagatgggccatatccaaatgggct

SEQ ID NO: 7129 - DNA, 50 bp, Homo sapiens
aagaactattcctttgagaatctttcctactgggagttactgctgtgatt

SEQ ID NO: 7130 - DNA, 50 bp, Homo sapiens
tctgtgtgaacatacatacaggactttgattctacctgtgcctgaccatt

SEQ ID NO: 7131 - DNA, 50 bp, Homo sapiens
gtggagctgttggccttgctggatgcgggcactctctacaccttcaggta

SEQ ID NO: 7132 - DNA, 50 bp, Homo sapiens
tgtcagtggctctcactttgtttgaaattgttgctttgggaaaaacacag

SEQ ID NO: 7133 - DNA, 50 bp, Homo sapiens
gatgcagtgggttaggggttgggggtacagactgacttgagctcggagtc

SEQ ID NO: 7134 - DNA, 50 bp, Homo sapiens
tcaggcactcagtaaaggcaagacttgagtgatacataaagtcagttaca

SEQ ID NO: 7135 - DNA, 50 bp, Homo sapiens
ccttgggctgagtttgctggtcctgaagattacagttttggttagagaga

SEQ ID NO: 7136 - DNA, 50 bp, Homo sapiens
acagcaaacaaagtgttccaatcctctattaacccatttaaccaagagtt

SEQ ID NO: 7137 - DNA, 50 bp, Homo sapiens; identical to SEQ ID NO: 6930

SEQ ID NO: 7138 - DNA, 50 bp, Homo sapiens
aagtgtgattagaagcagctggaagtagcagaggaggtggaagttagtcc

SEQ ID NO: 7139 - DNA, 50 bp, Homo sapiens
caggagtaaaacagagctggttgtgtgatacctatgctgggtggaagact

SEQ ID NO: 7140 - DNA, 50 bp, Homo sapiens
ggtgactatcttaccggctcccagtaaactctgaacaatgtaccagctaa

SEQ ID NO: 7141 - DNA, 50 bp, Homo sapiens
gcttgaagatgtctcaacagaaaatcaccgacatgaggaagcatcacgct

SEQ ID NO: 7142 - DNA, 56 bp, Homo sapiens
aggaacatggctgcagcatataaaaagaattgaattccatacttttgttaaccctg

SEQ ID NO: 7143 - DNA, 50 bp, Homo sapiens
ggtgctgccataggtgccagtaatgaccgtttatgcggaaatcaattaca

SEQ ID NO: 7144 - DNA, 50 bp, Homo sapiens
tgaagtactataggactcaatgggaccagtagcagctccaagtggatcac

SEQ ID NO: 7145 - DNA, 50 bp, Homo sapiens
acacgggacctcctttgatctttctgagaattaatagagatttcatggca

SEQ ID NO: 7146 - DNA, 50 bp, Homo sapiens
ccaaaaggagaaagatgactagggtcacacttgaggatttgccaggtggg

SEQ ID NO: 7147 - DNA, 50 bp, Homo sapiens
gcatcttctttgaagacgggaactgtacttcaggttcttttctgtttagc

SEQ ID NO: 7148 - DNA, 50 bp, Homo sapiens
ggctcatttggttttaaagtctcttctatgccatcccaggggaggaggat

SEQ ID NO: 7149 - DNA, 50 bp, Homo sapiens
gactgtggacacctctcactgtgtcttcttggcaggcagagcttactgac

SEQ ID NO: 7150 - DNA, 50 bp, Homo sapiens
gcagggtgcagagcttcacagcaggtaggaagaagtaactaagtggaaac

SEQ ID NO: 7151 - DNA, 50 bp, Homo sapiens
cagctaaagccgtaggtcattgtgactgtccctgggatgtggattactct

SEQ ID NO: 7152 - DNA, 50 bp, Homo sapiens
ccagaatgcagcctacagaccaaatatcaatggacttggtgtagccctgc

SEQ ID NO: 7153 - DNA, 50 bp, Homo sapiens
tttaaaccaggtctggaaaaaggaaggagaggagggcattttagagaaga

SEQ ID NO: 7154 - DNA, 50 bp, Homo sapiens
gtggcttcgtaaaatagaagagcagtcactgtggaactaccaaatggcga

SEQ ID NO: 7155 - DNA, 50 bp, Homo sapiens
cacaccacagctggctgggagcagaggctgctggtctcatagtaatctac

SEQ ID NO: 7156 - DNA, 50 bp, Homo sapiens
tggagaaaatgagagacagacagtgagtgagaaagtcagcgaaaaggaaa

SEQ ID NO: 7157 - DNA, 50 bp, Homo sapiens
acctactgttgagattattcccctgtctccacactgccagaaacttacca

SEQ ID NO: 7158 - DNA, 50 bp, Homo sapiens
ccaaatgatactaggattaagccccaaagcaaagtcaagcaccaccatgg

SEQ ID NO: 7159 - DNA, 50 bp, Homo sapiens
tcccagagcaacaactaagtctcaactaatggacaaccaacacccactga

SEQ ID NO: 7160 - DNA, 50 bp, Homo sapiens
ccacagaatgggcatgtagtattgagatttgaatcatctgctgtccagcc

SEQ ID NO: 7161 - DNA, 50 bp, Homo sapiens
acctcatccggctgctcaagtgcaagcgtgacagcttccccaacttcctg

SEQ ID NO: 7162 - DNA, 50 bp, Homo sapiens
gacctggtgctgtcgccctggcatcttaataaaacctgcttatacttccc

SEQ ID NO: 7163 - DNA, 50 bp, Homo sapiens
gcataaggaagacttgctcccctgtcctatgaaagagaatagttttggag

SEQ ID NO: 7164 - DNA, 50 bp, Homo sapiens
gggactcatctttccctccttggtgattccgcagtgagagagtggctggg

SEQ ID NO: 7165 - DNA, 50 bp, Homo sapiens
agactggatcgcacacctttgcaacagatgtgttctgattctctgaacct

SEQ ID NO: 7166 - DNA, 50 bp, Homo sapiens
aagcaaataccttttacaagtgaaaggaagaatttttcttctgccgtcaa

SEQ ID NO: 7167 - DNA, 50 bp, Homo sapiens
gcaacaaatgcttctattccatagctacggcattgctcagtaagttgagg

SEQ ID NO: 7168 - DNA, 50 bp, Homo sapiens
tccgtgtagaggttacagccttttatgctgttgagctcccaggtaccaaa

SEQ ID NO: 7169 - DNA, 50 bp, Homo sapiens
gcccacttggatttatagtatagcccttcctcgactcccaccagacttgc

SEQ ID NO: 7170 - DNA, 50 bp, Homo sapiens
aagagctcctgagccccctgcccccagagcaataaagtcagctggctttc

SEQ ID NO: 7171 - DNA, 50 bp, Homo sapiens
gctcaacatggaaagaaggtacagaaagtgatgtgttcaaaacattagca

SEQ ID NO: 7172 - DNA, 50 bp, Homo sapiens
ttatataccctggtcccatctttctagggcctggatctgcttatagagca

SEQ ID NO: 7173 - DNA, 50 bp, Homo sapiens
gtttactccgtccctatcactggtgtggctgtgggcaaaccacttattgc

SEQ ID NO: 7174 - DNA, 50 bp, Homo sapiens
gaactgaagcctgcacagtgtccaccctgttcccactcccatctttcttc

SEQ ID NO: 7175 - DNA, 50 bp, Homo sapiens
gaagaccaagagagacaacagacgcagcaaacagccgaagcaccagacaa

SEQ ID NO: 7176 - DNA, 50 bp, Homo sapiens
aattcagaaaattgttgggaggacagcccttttgtgaaccttgtttgggg

SEQ ID NO: 7177 - DNA, 50 bp, Homo sapiens
tttacccagctctgaaggtcattgttcttgcctgtgtttgaataaaatca

SEQ ID NO: 7178 - DNA, 50 bp, Homo sapiens
gtctctgatgctttgtatcattcttgagcaatcgctcggtccgtggacaa

SEQ ID NO: 7179 - DNA, 50 bp, Homo sapiens
ggtaagcccctgagcctgggacctacatgtggtttgcgtaataaaacatt

SEQ ID NO: 7180 - DNA, 50 bp, Homo sapiens
tctggctctgaccggttgatggccttgagcgaatgaaatcatgaaattga

SEQ ID NO: 7181 - DNA, 50 bp, Homo sapiens
tgccctacatagcaattttctgtggcactgagaaaccatgtatgaccaca

SEQ ID NO: 7182 - DNA, 50 bp, Homo sapiens
gcagtgtactgtgtgcaataccaagggcatagctccctgtaatttgggaa

SEQ ID NO: 7183 - DNA, 50 bp, Homo sapiens
ctgagactagggtcccagcacagcccagaaacctttggccacaagaagtg

SEQ ID NO: 7184 - DNA, 50 bp, Homo sapiens
tcgccttccatggtttttaaatgcagtaaataacatttctggatgagact

SEQ ID NO: 7185 - DNA, 50 bp, Homo sapiens
gctttacccccgcaggacatacacaggagcctttgatctcattaaagaga

SEQ ID NO: 7186 - DNA, 50 bp, Homo sapiens
ggaatgtacctctccccaacactgttttgttagcgagcaccttttgacca

SEQ ID NO: 7187 - DNA, 50 bp, Homo sapiens
actcgctcagaagagggaactaagcatttttggcaaccaatgggcagata

SEQ ID NO: 7188 - DNA, 50 bp, Homo sapiens
agctgtgtgaacctctcttattggaaattctgttccgtgtttgtgtaggt

SEQ ID NO: 7189 - DNA, 50 bp, Homo sapiens
agtcccatacatttggaccatggcagctaattttgtaacttaagcattca

SEQ ID NO: 7190 - DNA, 50 bp, Homo sapiens
ctgcccccttcctggacttcgtgccttactgagtctctaagactttttct

SEQ ID NO: 7191 - DNA, 50 bp, Homo sapiens
ggataacatttctcatgaacccactgcccctctgcattttcctcactggt

SEQ ID NO: 7192 - DNA, 50 bp, Homo sapiens
cgcttaagaacattgcctctgggtgtcatgtggaccagacttctgaatag

SEQ ID NO: 7193 - DNA, 50 bp, Homo sapiens
gggttcaatcccttcagctcaggcggaccatttagatttaaattccactt

SEQ ID NO: 7194 - DNA, 50 bp, Homo sapiens
gctcctgccagggctgttaccgttgttttcttgaatcactcacaatgaga

SEQ ID NO: 7195 - DNA, 50 bp, Homo sapiens
aatctggcgaaaccttcgtttgagggactgatgtgagtgtatgtccacct

SEQ ID NO: 7196 - DNA, 50 bp, Homo sapiens
gactatgggctctgaagggggcaggagtcagcaataaagctatgtctgat

SEQ ID NO: 7197 - DNA, 50 bp, Homo sapiens
agggaggggacagatggggagcttttcttacctattcaaggaatacgtgc

SEQ ID NO: 7198 - DNA, 50 bp, Homo sapiens
accttctgaaagctcacagtacacattagtatgtataactggctttacca

SEQ ID NO: 7199 - DNA, 50 bp, Homo sapiens
tttaagggagtcaggaatagatgtatgaacagtcgtgtcactggatgcct

SEQ ID NO: 7200 - DNA, 50 bp, Homo sapiens
cccaccttccacctcttagcactggtgaccccaaaaatgaaaccatcaat

SEQ ID NO: 7201 - DNA, 50 bp, Homo sapiens
agaccagcagtgtttaaatctaaatacgttgtgagtctgttatctgtcct

SEQ ID NO: 7202 - DNA, 50 bp, Homo sapiens
acctcgacctcagagcctcccacccagaagatcctgcttccgtggttgag

SEQ ID NO: 7203 - DNA, 50 bp, Homo sapiens
gggcagtgggtcccagattggctcacactgagaatgtaagaactacaaac

SEQ ID NO: 7204 - DNA, 50 bp, Homo sapiens
tggccttaagttttctaattcaagcgggtttttggaaaaatttatggtct

SEQ ID NO: 7205 - DNA, 50 bp, Homo sapiens
tgcagagttataagccccaaacaggtcatgctccaataaaaatgattcta

SEQ ID NO: 7206 - DNA, 50 bp, Homo sapiens
ccaaacaatgatgtggattcttttgcacagaaatatttaaggtgggatgg

SEQ ID NO: 7207 - DNA, 50 bp, Homo sapiens
acaaaagtcaactgttgtctcttttcaaaccaaattgggagaattgttgc

SEQ ID NO: 7208 - DNA, 50 bp, Homo sapiens
gctggggactctagcctctgtgttcataaagacattaagaagtggatgga

SEQ ID NO: 7209 - DNA, 50 bp, Homo sapiens
ggagaatgacacatcaagctgctaacaattgggggaaggggaaggaagaa

SEQ ID NO: 7210 - DNA, 50 bp, Homo sapiens
acctgggtttaatacagctcacatcactgaatgttacacatgagtttaaa

SEQ ID NO: 7211 - DNA, 50 bp, Homo sapiens
cttaaggacgcctttgcctggcccctttattacagcccaacacggtaggc

SEQ ID NO: 7212 - DNA, 50 bp, Homo sapiens
tccatcagtgccatttcctgtagaactaaaggctgttccaagaatgtggg

SEQ ID NO: 7213 - DNA, 50 bp, Homo sapiens
atctgtaaagcactcagaaggcagccatccctagatgttggtttcatgta

SEQ ID NO: 7214 - DNA, 50 bp, Homo sapiens
tggttagattgttttcacttggtgatcatgtcttttccatgtgtacctgt

SEQ ID NO: 7215 - DNA, 50 bp, Homo sapiens
catgtcccttgaaacatgatagttacatacacagttttctctccacacat

SEQ ID NO: 7216 - DNA, 50 bp, Homo sapiens
aggtttcacatgaacctgttctaggctgtggacattggtgtggagaggtt

SEQ ID NO: 7217 - DNA, 50 bp, Homo sapiens
gacacttggggtccacaatcccaggtccatactctaggttttggatacca

SEQ ID NO: 7218 - DNA, 50 bp, Homo sapiens
agaaatgatttgcagctgagtgaatcaggaagtgacagtgatgactgaag

SEQ ID NO: 7219 - DNA, 50 bp, Homo sapiens
tcctgagagatggacaatgaaatatcagttggtggatatgtgtgatagct

SEQ ID NO: 7220 - DNA, 50 bp, Homo sapiens
ctttcagggcaggcagctgtgcatgttctctcaactaaaggtcttgtgag

SEQ ID NO: 7221 - DNA, 50 bp, Homo sapiens
gctggacacacggtgagattttctcgtatgtaaataaaaggcaatttggt

SEQ ID NO: 7222 - DNA, 50 bp, Homo sapiens
ctcaacgaaaggctcacactaacaggggaggattacagcaccacaatact

SEQ ID NO: 7223 - DNA, 50 bp, Homo sapiens
ccacactgaacccaattacacacagcgggagaacgcagtaaacagctttc

SEQ ID NO: 7224 - DNA, 50 bp, Homo sapiens
aggccctggaaaattttgtgcttccaacgtggccttcaattcttgctttt

SEQ ID NO: 7225 - DNA, 50 bp, Homo sapiens
tattaagcttgcccaggctcctgttcatgaaggttcccccagcggtggcc

SEQ ID NO: 7226 - DNA, 50 bp, Homo sapiens
gctataccactgactgtattgaaaaccaaagtattaagaggggaaacgcc

SEQ ID NO: 7227 - DNA, 50 bp, Homo sapiens
tcggggtcagttaagcctcagtattcttagcttttgttgattttggcact

SEQ ID NO: 7228 - DNA, 50 bp, Homo sapiens
atggtgcaaaccctggaacagtatgaattctgctacaaagtggtacaaga

SEQ ID NO: 7229 - DNA, 50 bp, Homo sapiens
agaagcagcgagtgcatgggctaattatcatcaatctttatgtatttgtt

SEQ ID NO: 7230 - DNA, 50 bp, Homo sapiens
ggaaatgttgctgtgggggattcattgtaactctccttgtgaactgctca

SEQ ID NO: 7231 - DNA, 50 bp, Homo sapiens
atgccaaattcctgacacgtggcgtttgaaaataccatggaacgtttcca

SEQ ID NO: 7232 - DNA, 50 bp, Homo sapiens
acattctgactccatctgcggcctcattaaggtgatagaaacatactagg

SEQ ID NO: 7233 - DNA, 50 bp, Homo sapiens
atgataatgttggcatctgtgataaactatcaatgaggctcccatcatgc

SEQ ID NO: 7234 - DNA, 50 bp, Homo sapiens
agagtcacatgtagaaaagcctccagtattaagctcctgaattcattcct

SEQ ID NO: 7235 - DNA, 50 bp, Homo sapiens
atggcaacaatgctgacagcaagcagtagatcctctgattccaattacca

SEQ ID NO: 7236 - DNA, 50 bp, Homo sapiens
gggaaccctcattaattagacaagaacaccaaggctatgaccacagcagc

SEQ ID NO: 7237 - DNA, 50 bp, Homo sapiens
ggctcaccagagtacccagaagaatcagtatggaattagaggacagtggc

SEQ ID NO: 7238 - DNA, 50 bp, Homo sapiens
attccaggccctcagtctttggcaatggccaccctggtgttggcatattg

SEQ ID NO: 7239 - DNA, 50 bp, Homo sapiens
gcatacataaaggcaaagaatgacaaaaggcttaatccacctagaagaca

SEQ ID NO: 7240 - DNA, 50 bp, Homo sapiens
atatagtgggagacaaaacacaggaggcgggggatatcatgtagcagagc

SEQ ID NO: 7241 - DNA, 50 bp, Homo sapiens
tctaatgtgccttggatatgtgccaaatgatggaaaagaaacagtaaact

SEQ ID NO: 7242 - DNA, 50 bp, Homo sapiens
gcttggctcatctggggtttgctgggcttaacacccaataaagaactttg

SEQ ID NO: 7243 - DNA, 50 bp, Homo sapiens
ctgcggttttggaaccttacctctcctccttagcccaatatgctgtcttg

SEQ ID NO: 7244 - DNA, 50 bp, Homo sapiens
tccaggccattttgcagggactctgaagtgacctttagtagtaatagtct

SEQ ID NO: 7245 - DNA, 50 bp, Homo sapiens
tggcagccaggaactgagtatgacaatgttgtactaaagaaaggcccaaa

SEQ ID NO: 7246 - DNA, 50 bp, Homo sapiens
agagagagacatatcacgctgctgtcatgattttgtgtcaagatgatcca

SEQ ID NO: 7247 - DNA, 50 bp, Homo sapiens
cttctggggacctttcctacccccatcagcatcaataaaacctcctgtct

SEQ ID NO: 7248 - DNA, 50 bp, Homo sapiens
tagatgatttctagcaggcaggaagtcctgtgcggtgtcaccatgagcac

SEQ ID NO: 7249 - DNA, 50 bp, Homo sapiens
ccatggtctggggcttgaggaagatgagtttgttgatttaaataaagaat

SEQ ID NO: 7250 - DNA, 50 bp, Homo sapiens
aggtcaagggcttactatttctgggtcttttgctactaagttcacattag

SEQ ID NO: 7251 - DNA, 50 bp, Homo sapiens
tttctggggacctcttgaattacatgctgtaacatatgaagtgatgtggt

SEQ ID NO: 7252 - DNA, 50 bp, Homo sapiens
tggcacaaaacctcctcctcccaggcactcatttatattgctctgaaaga

SEQ ID NO: 7253 - DNA, 50 bp, Homo sapiens
tgaggtcactgccacttctcacatgctgcttaagggagcacaaataaagg

SEQ ID NO: 7254 - DNA, 50 bp, Homo sapiens
cacgctaccccctgccttgggaggtgtgtggaataaattatttttgttaa

SEQ ID NO: 7255 - DNA, 50 bp, Homo sapiens
aatgcagagaatggaaagtagcgcatccctgaggctggactccagatctg

SEQ ID NO: 7256 - DNA, 50 bp, Homo sapiens
gtggcacaccactccttccagcagtagtcgctttactgttacctgtttag

SEQ ID NO: 7257 - DNA, 50 bp, Homo sapiens
agcaacagtattctgcatggttcactgcttaagaaaatgccttctggaat

SEQ ID NO: 7258 - DNA, 50 bp, Homo sapiens
aaacatgtccctggagagtagcctgctcccacactgtcactggatgtcat

SEQ ID NO: 7259 - DNA, 50 bp, Homo sapiens
cagttgcagcctcttgacctcggataacaataagagagctcatctcattt

SEQ ID NO: 7260 - DNA, 50 bp, Homo sapiens
tgggcttggtcttccagttggcatttgcctgaagttgtattgaaacaatt

SEQ ID NO: 7261 - DNA, 50 bp, Homo sapiens
ttctgccgtgtgtatccccaacccttgacccaatgacaccaaacacagtg

SEQ ID NO: 7262 - DNA, 50 bp, Homo sapiens
tgtgtgcgacagggaggaagtttcaataaagcaacaacaagcttcaagga

SEQ ID NO: 7263 - DNA, 50 bp, Homo sapiens
ctccccttgggcggctgagagccccagctgacatggaaatacagttgttg

SEQ ID NO: 7264 - DNA, 50 bp, Homo sapiens
ctccaccacctgaccagagtgttctcttcagaggactggctcctttccca

SEQ ID NO: 7265 - DNA, 50 bp, Homo sapiens
ctctgccctcctgtcacccagtagagtaaataaacttccttggctcctaa

SEQ ID NO: 7266 - DNA, 50 bp, Homo sapiens
aaattccagccttgactttcttctgtgcacctgatgggagggtaatgtct

SEQ ID NO: 7267 - DNA, 50 bp, Homo sapiens
ctgtaggccagggtggaatgaagtcagctcctttttatagttgaaataca

SEQ ID NO: 7268 - DNA, 50 bp, Homo sapiens
ttggcgggccatcccaacaggtgatgaccccacaaggaagaggtactgtt

SEQ ID NO: 7269 - DNA, 50 bp, Homo sapiens
ggaagatggaaataaacctgcgtgtgggtggagtgttctcgtgccgaatt

SEQ ID NO: 7270 - DNA, 50 bp, Homo sapiens
agtgaggacaatgtggcttgctcctttttgaatctacagataatgcatgt

SEQ ID NO: 7271 - DNA, 50 bp, Homo sapiens
gagggtgggggagggaggtggagggagggaagggtttctctattaaaatg

SEQ ID NO: 7272 - DNA, 50 bp, Homo sapiens
tgctgactgtagctttggaagtttagctctgagaaccgtagatgatttca

SEQ ID NO: 7273 - DNA, 50 bp, Homo sapiens
gattgaggaaggtccgcacagcctgtctctgctcagttgcaataaacgtg

SEQ ID NO: 7274 - DNA, 50 bp, Homo sapiens
gattcttgtctggctaataaatcatcaccaactgccttctcctacaggga

SEQ ID NO: 7275 - DNA, 50 bp, Homo sapiens
agattcttagggcacgtttgttccccttggagggttttccacacggagtc

SEQ ID NO: 7276 - DNA, 50 bp, Homo sapiens
gccatactctggctgcctctttgccttcctaggggcattttctttaactt

SEQ ID NO: 7277 - DNA, 50 bp, Homo sapiens
tgcctcttatctacttgagagcaacatgtcttttcaatcatgggattgac

SEQ ID NO: 7278 - DNA, 50 bp, Homo sapiens
tggacctgtgacattctggactatttctgtgtttatttgtggccgagtgt

SEQ ID NO: 7279 - DNA, 50 bp, Homo sapiens
tgaaggtgtctgtgacctctttgatgtgcctgttctcaacctctgactga

SEQ ID NO: 7280 - DNA, 50 bp, Homo sapiens
cctggagtccctgaataaagataagaagcatcactgaagataatacctgg

SEQ ID NO: 7281 - DNA, 50 bp, Homo sapiens
ttgtcccgaagatttgcgcctttagtgccttttgaggggttcccatcatc

SEQ ID NO: 7282 - DNA, 50 bp, Homo sapiens
ctgctaggctctgcccaccggccaccaacactcctgtaattccaataaag

SEQ ID NO: 7283 - DNA, 50 bp, Homo sapiens
ttaaaatactgtcattggttgggaggggattgcattaaatgattagtcca

SEQ ID NO: 7284 - DNA, 50 bp, Homo sapiens
ctcacacacgcaggcgacagtcagaacaaacaggaacaaagctacaacac

SEQ ID NO: 7285 - DNA, 50 bp, Homo sapiens
tgaatagtgtgcagactcacagataataaagctcagagcagctcccggca

SEQ ID NO: 7286 - DNA, 50 bp, Homo sapiens
cccagtgcttcacgaagttaaaggaaagatctgctggtagtgtttagtct

SEQ ID NO: 7287 - DNA, 50 bp, Homo sapiens
cgagccgaccatgtcttcatttgcttccacaagaaccgcgaggacagagc

SEQ ID NO: 7288 - DNA, 50 bp, Homo sapiens
ttttccccctttagtctcctggctttttcctttcccttcccttctccact

SEQ ID NO: 7289 - DNA, 50 bp, Homo sapiens
aacccgttgtggaaattattggaattaactgagccaaagtgattatgcat

SEQ ID NO: 7290 - DNA, 50 bp, Homo sapiens
gcccccgatcctacaccctgagcctcagagcactgctactttttaaaata

SEQ ID NO: 7291 - DNA, 50 bp, Homo sapiens
aagcgtctcatggagttcggactggttggggtgataatatttgtttcttt

SEQ ID NO: 7292 - DNA, 50 bp, Homo sapiens
aagccaggctttgggatacaagttctttcctcttcatttgatgccgtgca

SEQ ID NO: 7293 - DNA, 50 bp, Homo sapiens
agctgtcaccactacagtaagctggtttacagatgttttccactgagcat

SEQ ID NO: 7294 - DNA, 50 bp, Homo sapiens
tgaaggtacatcgtttgcaaatgtgagtttcctctcctgtccgtgtttgt

SEQ ID NO: 7295 - DNA, 50 bp, Homo sapiens
ggatacaaactggtattctgttctggaggaaagggaggagtggaggtggg

SEQ ID NO: 7296 - DNA, 50 bp, Homo sapiens
ctgccgctgcccagccacatcccttggttttgtattttatttacagagtt

SEQ ID NO: 7297 - DNA, 50 bp, Homo sapiens
tgcagtagacgatacaggttgcatgtggacactcagtcacattaacaact

SEQ ID NO: 7298 - DNA, 50 bp, Homo sapiens
ccccaaccacaggcatcaggcaaccatttgaaataaaactccttcagcct

SEQ ID NO: 7299 - DNA, 50 bp, Homo sapiens
gtactgaggtgactggtatagtctgatgagaaagatgtggattgccataa

SEQ ID NO: 7300 - DNA, 50 bp, Homo sapiens
cacttgttcaatcatggaactttctagaacgctgccactcttcaaaggct

SEQ ID NO: 7301 - DNA, 50 bp, Homo sapiens
tcatcacagtgtggtaaggttgcaaattcaaaacatgtcacccaagctct

SEQ ID NO: 7302 - DNA, 50 bp, Homo sapiens
acaacctgatcattgaagccaactttgtcccagcacattccttaagtcct

SEQ ID NO: 7303 - DNA, 50 bp, Homo sapiens
acttgattaggctccggttttcctttggcttctgcttttcagtgaatggc

SEQ ID NO: 7304 - DNA, 50 bp, Homo sapiens
ttgcagacaaattcctctgagcttagctaggagttcattatgcttcctgt

SEQ ID NO: 7305 - DNA, 50 bp, Homo sapiens
acagtagcttagcatcagaggtttgcttcctcagtaacatttctgttctc

SEQ ID NO: 7306 - DNA, 50 bp, Homo sapiens
atgtgagccagagcatgttgcagcaaatctattgtttgtaaaaataacaa

SEQ ID NO: 7307 - DNA, 50 bp, Homo sapiens
tttgtgccatgtggctacattagttgatgtttatcgagttcattggtcaa

SEQ ID NO: 7308 - DNA, 50 bp, Homo sapiens
agcccaaccattaaaaatttaatacaacttggtttctccccctttttcct

SEQ ID NO: 7309 - DNA, 50 bp, Homo sapiens
gcaaagaaagaagaatccgaggagtctgatgatgacatgggctttggtct

SEQ ID NO: 7310 - DNA, 50 bp, Homo sapiens; identical to SEQ ID NO: 6184

SEQ ID NO: 7311 - DNA, 50 bp, Homo sapiens
ttttcctgaccaagactgagggatgggctggaggttttcaactttgctac

SEQ ID NO: 7312 - DNA, 50 bp, Homo sapiens
tctgggactgggcaaatgtttgtgtggcctccttaaactagctgttatgt

SEQ ID NO: 7313 - DNA, 50 bp, Homo sapiens
aacctaaacgtatttcactaactctggctccttctccataaagcacattt

SEQ ID NO: 7314 - DNA, 50 bp, Homo sapiens
ccaccaaatgcatgtcatgtattctcaataggctgtattcccagcagtca

SEQ ID NO: 7315 - DNA, 50 bp, Homo sapiens
tgtacaggtagctaactttgtaaacgctgtgtattccctctgcccccatg

SEQ ID NO: 7316 - DNA, 50 bp, Homo sapiens
tctcatcatttcgaagatagcagagtcatagttgggcacccagtgattgg

SEQ ID NO: 7317 - DNA, 50 bp, Homo sapiens
caacaaggtggaaacaagggctggagctgcgtttgttttgccatcactat

SEQ ID NO: 7318 - DNA, 50 bp, Homo sapiens
gagcattcctcaggggaggtcacctgtgaggttcccagaactgtagtttt

SEQ ID NO: 7319 - DNA, 50 bp, Homo sapiens
tgcaggtgttgacaagatccgccatctgtaatgtccttggcacaataaaa

SEQ ID NO: 7320 - DNA, 50 bp, Homo sapiens
aagagtctgacttctcactaggagcatgtctgttgtacttacttcaaaca

SEQ ID NO: 7321 - DNA, 50 bp, Homo sapiens
caaacaccaaaccaagataacaccggaacgataaacagcagaaacagaga

SEQ ID NO: 7322 - DNA, 50 bp, Homo sapiens
tgggtttgtccagttcaggctagatgtgcatcatggcaggaagaaagaag

SEQ ID NO: 7323 - DNA, 50 bp, Homo sapiens
aaggatgttccttcaggaggaagcagcactaaaagcactctgagtcaaga

SEQ ID NO: 7324 - DNA, 50 bp, Homo sapiens
cggaagccaccgtgtggttctttcacaggcacgtttattttgctgaaata

SEQ ID NO: 7325 - DNA, 50 bp, Homo sapiens
cctccactcagctgtcctgcagcaaacactccaccctccaccttccattt

SEQ ID NO: 7326 - DNA, 50 bp, Homo sapiens
tccctccttccagtgttccttagaacagacatttaggtatctcaggtcct

SEQ ID NO: 7327 - DNA, 50 bp, Homo sapiens
cagccgcagcatctaaacgaacaacagaggagaacgacgaggacagagtt

SEQ ID NO: 7328 - DNA, 50 bp, Homo sapiens
tcactggatttctgtgtcttcactagaacaccattgtcatctcatattga

SEQ ID NO: 7329 - DNA, 50 bp, Homo sapiens
gcttctctcgcacccccagcacctctgtcccaaaacctcattcccttttt

SEQ ID NO: 7330 - DNA, 50 bp, Homo sapiens
agctgctcacagacaccagcaaagcaatgtgctcctgatcaagtagattt

SEQ ID NO: 7331 - DNA, 50 bp, Homo sapiens
atgctcatgtggtgtccccaccgcccacttgtttgatgtcactgactgtc

SEQ ID NO: 7332 - DNA, 50 bp, Homo sapiens
gctgagtgtgtcgctccctggtccactgtttctcctataaatgtaaatgg

SEQ ID NO: 7333 - DNA, 50 bp, Homo sapiens
tgcagcacattgataagatggtttccgtgagctatgataagattgaaatt

SEQ ID NO: 7334 - DNA, 50 bp, Homo sapiens
ataaatatgcagtgatatggcagaagacaccagagcagatgcagagagcc

SEQ ID NO: 7335 - DNA, 50 bp, Homo sapiens
ttgaaccgggaagtgggaggacgtagagcagagaagagaacatttttaaa

SEQ ID NO: 7336 - DNA, 50 bp, Homo sapiens
tttgctcattctaaactcaagcttttaagcctcacagaatttacaggggt

SEQ ID NO: 7337 - DNA, 50 bp, Homo sapiens
gccataggcttacatggggcatactcgttacacagtcagaatgtttgaaa

SEQ ID NO: 7338 - DNA, 50 bp, Homo sapiens
ggtctctcgctctgtctttccagcatccactctcccttgtccttctgggg

SEQ ID NO: 7339 - DNA, 50 bp, Homo sapiens
tcagcaccaagtcatgtttaaaagaccagagagacaagcattttgccaag

SEQ ID NO: 7340 - DNA, 50 bp, Homo sapiens
cgaaccctgtctagaaggaatgtatttgttgctaaatttcgtagcactgt

SEQ ID NO: 7341 - DNA, 50 bp, Homo sapiens
caaatggccttggtcccgcagcttgtgtgcgtgagtgcagtgtgagtgtg

SEQ ID NO: 7342 - DNA, 50 bp, Homo sapiens
ctcttggaaagacttctctgccatccctttgcacctgagaggggaagttc

SEQ ID NO: 7343 - DNA, 50 bp, Homo sapiens
ggcgcggtgacccacttatgggacttggcctttctttgttgtttgtttaa

SEQ ID NO: 7344 - DNA, 52 bp, Homo sapiens
acccagttcatgattacttctactcttaacactcaatccccctaattaaacc

SEQ ID NO: 7345 - DNA, 50 bp, Homo sapiens
ttcgataaacagcgttgacttgcttgtaccacttaagagttgtgagtgct

SEQ ID NO: 7346 - DNA, 50 bp, Homo sapiens
tccagaactttgtctatcactctccccaacaacctagatgtgaaaacaga

SEQ ID NO: 7347 - DNA, 50 bp, Homo sapiens
gggatctttcaaatggatagtgagttgccttttcctataggtgacaatca

SEQ ID NO: 7348 - DNA, 50 bp, Homo sapiens
agagcaagcattacagaaaataggtctggaagacaggaaaaggacaaaga

SEQ ID NO: 7349 - DNA, 50 bp, Homo sapiens
atgtgtcctgcccctcagctctttgccttatctgtgtcactgtcacttta

SEQ ID NO: 7350 - DNA, 50 bp, Homo sapiens
tcctgtgaattgaatttctcttcaatcaaagtgccccaaacagaagcaca

SEQ ID NO: 7351 - DNA, 50 bp, Homo sapiens
aggtcccctgcctggtacaaagaaaagcaaaaagaatttacgaagattgt

SEQ ID NO: 7352 - DNA, 50 bp, Homo sapiens
gccagaagcataatttaccagagacgagaacagggtgtgggagagaggaa

SEQ ID NO: 7353 - DNA, 50 bp, Homo sapiens
tctttcttccctcgtgacagtggtgtgtggtgtcgtctgtgaatgctaag

SEQ ID NO: 7354 - DNA, 50 bp, Homo sapiens
cagtcaaacattttaccttgtgccttggctcactctgtgccttttctcca

SEQ ID NO: 7355 - DNA, 50 bp, Homo sapiens
acaggaaacgggctttctctgaattggtaaatgggaaagaagtgagcaac

SEQ ID NO: 7356 - DNA, 50 bp, Homo sapiens; identical to SEQ ID NO: 4610

SEQ ID NO: 7357 - DNA, 50 bp, Homo sapiens
accctcgccacaagattctgcaatctcctaaagtacagatgagaaaggaa

SEQ ID NO: 7358 - DNA, 50 bp, Homo sapiens
tgccaaggggttaatgaaacaaatagctgttgacgtttgctcatttaaga

SEQ ID NO: 7359 - DNA, 50 bp, Homo sapiens
cagtggcacaccttaaccagtcactaattttcactgttgtgaaagtgatt

SEQ ID NO: 7360 - DNA, 50 bp, Homo sapiens
cccagtgccacagagaagacgggatttgaagctgtacccaatttaattcc

SEQ ID NO: 7361 - DNA, 50 bp, Homo sapiens
tgagccctactccctgcagatgccaccctagccaatgtctcctccccttc

SEQ ID NO: 7362 - DNA, 50 bp, Homo sapiens
gcagggaggggaggataagtgggatctaccaattgattctggcaaaacaa

SEQ ID NO: 7363 - DNA, 50 bp, Homo sapiens
ggccactacctttgttggaaacaaagcataagggagtgaaagtgtctaaa

SEQ ID NO: 7364 - DNA, 50 bp, Homo sapiens
gctggcccgatctctccccacagttgcaagaagcattttcaaagaatagt

SEQ ID NO: 7365 - DNA, 50 bp, Homo sapiens
attgggatgaaactactttagcaaagtccacagatcagaaaccagacggt

SEQ ID NO: 7366 - DNA, 50 bp, Homo sapiens
aggagactgggtgctataattagattattttgaggcagacagagagctgt

SEQ ID NO: 7367 - DNA, 50 bp, Homo sapiens
agcctgcaaggttaggacttgaagagggaaggtatttaataactgggcga

SEQ ID NO: 7368 - DNA, 50 bp, Homo sapiens
ttagtgcagttggaatgaatgtgtataggtcagaggtcttcgtgttcaca

SEQ ID NO: 7369 - DNA, 50 bp, Homo sapiens
tcacctctcagttgaaagatttcttctttgaaaggtcaagaccgtgaact

SEQ ID NO: 7370 - DNA, 50 bp, Homo sapiens
agtctggatgtaaggcctgcctcaaagagacactaatgggagggaacaaa

SEQ ID NO: 7371 - DNA, 50 bp, Homo sapiens
aaaggaagaagcacgatgcaaacagaaacaagacgagacagagtgagcga

SEQ ID NO: 7372 - DNA, 50 bp, Homo sapiens
actgcttcaagtcttgacccctttgtgtctaatagctaaacaaacatgtg

SEQ ID NO: 7373 - DNA, 50 bp, Homo sapiens
aacaataggaataaggttacttcagccttaaggggcttatcatactgctg

SEQ ID NO: 7374 - DNA, 50 bp, Homo sapiens
gacagggaaatctgcctaccaagaggggtgtgtgtgtctttgtgcccaca

SEQ ID NO: 7375 - DNA, 50 bp, Homo sapiens
aacaagtccatgactcccaagggtttaaggaccaatggttcagtgagaca

SEQ ID NO: 7376 - DNA, 50 bp, Homo sapiens
acactcatactcatatgtacgtgctcagtcgaacggactgcagtccgttc

SEQ ID NO: 7377 - DNA, 50 bp, Homo sapiens
tactgctatggaatgagaccaccacttctcctgttgtccttcccagcttc

SEQ ID NO: 7378 - DNA, 50 bp, Homo sapiens
tgccaagtgaggacaaactgctaggctgtatcccataatttcaggatgag

SEQ ID NO: 7379 - DNA, 50 bp, Homo sapiens
aaaccgaccgcctgtaggctcctggaactatacagataggtaaagagttc

SEQ ID NO: 7380 - DNA, 50 bp, Homo sapiens
gaccaatcatcagactccttgaactcccccactctgctggctctgtaacc

SEQ ID NO: 7381 - DNA, 50 bp, Homo sapiens
agagatccaggtgcaagtggattgagacagcagcaacagctcaagagata

SEQ ID NO: 7382 - DNA, 50 bp, Homo sapiens
atgtccctttctcctctcccctcttcctcttactgctgttctccctttct

SEQ ID NO: 7383 - DNA, 50 bp, Homo sapiens
acatccatagaacaatacatcaaagttgttgaagtgttgcaggggagggc

SEQ ID NO: 7384 - DNA, 50 bp, Homo sapiens
agcacttactgtcaggcattcagaatgtgagcaatgacaataatttacct

SEQ ID NO: 7385 - DNA, 50 bp, Homo sapiens
aatctgattgagtctccactccacaagcactcagggttccccagcagctc

SEQ ID NO: 7386 - DNA, 50 bp, Homo sapiens
aacccaagaaaagagttgctcttactatctactgctgactcttgaacttt

SEQ ID NO: 7387 - DNA, 50 bp, Homo sapiens
ttcgtaggtgggcttttcctatcagagcttggctcataaccaaataaagt

SEQ ID NO: 7388 - DNA, 50 bp, Homo sapiens
aggtgggctggacttctacctgccctcaagggtgtgtatattgtataggg

SEQ ID NO: 7389 - DNA, 50 bp, Homo sapiens
tgtgtcagaatggcactagttcagtttatgtcccttctgatatagtagct

SEQ ID NO: 7390 - DNA, 50 bp, Homo sapiens
ctatcagccccaagtggagcagaacagagggatttgggaggaatgtcctc

SEQ ID NO: 7391 - DNA, 50 bp, Homo sapiens
tgctaaggagaggggccatgaagagttttgttgagaacatcgtgtctgag

SEQ ID NO: 7392 - DNA, 50 bp, Homo sapiens
agtcagaacttcaagtccccattaaaggggctggaaaatacaagtacagt

SEQ ID NO: 7393 - DNA, 50 bp, Homo sapiens
ctccccttcctgcacccgtacccccgtggtctttgaataaagtctgagtg

SEQ ID NO: 7394 - DNA, 50 bp, Homo sapiens
cagatggttgtggggtcaagtacatccccagtcgtggccctttggacaag

SEQ ID NO: 7395 - DNA, 50 bp, Homo sapiens
ttttggcctgtttgatgtatgtgtgaaacaatgttgtccaacaataaaca

SEQ ID NO: 7396 - DNA, 50 bp, Homo sapiens
agcctaggtgacagagcaagactccatttcaaaaacaaaacaaaacaaaa

SEQ ID NO: 7397 - DNA, 50 bp, Homo sapiens
acactgagaatacacgacatacacgcacgcacaagacaacaacagacagc

SEQ ID NO: 7398 - DNA, 50 bp, Homo sapiens; identical to SEQ ID NO: 6714

SEQ ID NO: 7399 - DNA, 50 bp, Homo sapiens; identical to SEQ ID NO: 6715

SEQ ID NO: 7400 - DNA, 50 bp, Homo sapiens; identical to SEQ ID NO: 6716

SEQ ID NO: 7401 - DNA, 50 bp, Homo sapiens; identical to SEQ ID NO: 6717

SEQ ID NO: 7402 - DNA, 50 bp, Homo sapiens; identical to SEQ ID NO: 6718

SEQ ID NO: 7403 - DNA, 50 bp, Homo sapiens; identical to SEQ ID NO: 6719

SEQ ID NO: 7404 - DNA, 50 bp, Homo sapiens; identical to SEQ ID NO: 6720

SEQ ID NO: 7405 - DNA, 50 bp, Homo sapiens; identical to SEQ ID NO: 6721

SEQ ID NO: 7406 - DNA, 50 bp, Homo sapiens; identical to SEQ ID NO: 6722

SEQ ID NO: 7407 - DNA, 50 bp, Homo sapiens; identical to SEQ ID NO: 6723

SEQ ID NO: 7408 - DNA, 50 bp, Homo sapiens; identical to SEQ ID NO: 6724

SEQ ID NO: 7409 - DNA, 50 bp, Homo sapiens; identical to SEQ ID NO: 6725

SEQ ID NO: 7410 - DNA, 50 bp, Homo sapiens; identical to SEQ ID NO: 6726

SEQ ID NO: 7411 - DNA, 50 bp, Homo sapiens; identical to SEQ ID NO: 6727

SEQ ID NO: 7412 - DNA, 50 bp, Homo sapiens; identical to SEQ ID NO: 6728

SEQ ID NO: 7413 - DNA, 50 bp, Homo sapiens; identical to SEQ ID NO: 6729

SEQ ID NO: 7414 - DNA, 50 bp, Homo sapiens; identical to SEQ ID NO: 6730

SEQ ID NO: 7415 - DNA, 50 bp, Homo sapiens; identical to SEQ ID NO: 6731

SEQ ID NO: 7416 - DNA, 50 bp, Homo sapiens; identical to SEQ ID NO: 6732

SEQ ID NO: 7417 - DNA, 50 bp, Homo sapiens; identical to SEQ ID NO: 6733

SEQ ID NO: 7418 - DNA, 50 bp, Homo sapiens; identical to SEQ ID NO: 6734

SEQ ID NO: 7419 - DNA, 50 bp, Homo sapiens; identical to SEQ ID NO: 6735

SEQ ID NO: 7420 - DNA, 50 bp, Homo sapiens; identical to SEQ ID NO: 6736

SEQ ID NO: 7421 - DNA, 50 bp, Homo sapiens; identical to SEQ ID NO: 6737

SEQ ID NO: 7422 - DNA, 50 bp, Homo sapiens; identical to SEQ ID NO: 6738

SEQ ID NO: 7423 - DNA, 50 bp, Homo sapiens; identical to SEQ ID NO: 4953

SEQ ID NO: 7424 - DNA, 50 bp, Homo sapiens; identical to SEQ ID NO: 6740

SEQ ID NO: 7425 - DNA, 50 bp, Homo sapiens; identical to SEQ ID NO: 6741

SEQ ID NO: 7426 - DNA, 50 bp, Homo sapiens; identical to SEQ ID NO: 6742

SEQ ID NO: 7427 - DNA, 50 bp, Homo sapiens; identical to SEQ ID NO: 6743

SEQ ID NO: 7428 - DNA, 50 bp, Homo sapiens; identical to SEQ ID NO: 6744

SEQ ID NO: 7429 - DNA, 50 bp, Homo sapiens; identical to SEQ ID NO: 6745

SEQ ID NO: 7430 - DNA, 50 bp, Homo sapiens; identical to SEQ ID NO: 6746

SEQ ID NO: 7431 - DNA, 50 bp, Homo sapiens; identical to SEQ ID NO: 6540

SEQ ID NO: 7432 - DNA, 50 bp, Homo sapiens; identical to SEQ ID NO: 6748

SEQ ID NO: 7433 - DNA, 50 bp, Homo sapiens; identical to SEQ ID NO: 6749

SEQ ID NO: 7434 - DNA, 50 bp, Homo sapiens; identical to SEQ ID NO: 6750

SEQ ID NO: 7435 - DNA, 50 bp, Homo sapiens; identical to SEQ ID NO: 6751

SEQ ID NO: 7436 - DNA, 56 bp, Homo sapiens
acaaaagtatggaattcaattctttttatatgctgcagccatgttcctgccctaga

SEQ ID NO: 7437 - DNA, 50 bp, Homo sapiens; identical to SEQ ID NO: 6753

SEQ ID NO: 7438 - DNA, 50 bp, Homo sapiens; identical to SEQ ID NO: 6754

SEQ ID NO: 7439 - DNA, 50 bp, Homo sapiens; identical to SEQ ID NO: 6755

SEQ ID NO: 7440 - DNA, 50 bp, Homo sapiens; identical to SEQ ID NO: 6756

SEQ ID NO: 7441 - DNA, 50 bp, Homo sapiens; identical to SEQ ID NO: 6757

SEQ ID NO: 7442 - DNA, 50 bp, Homo sapiens; identical to SEQ ID NO: 6758

SEQ ID NO: 7443 - DNA, 50 bp, Homo sapiens; identical to SEQ ID NO: 6759

SEQ ID NO: 7444 - DNA, 50 bp, Homo sapiens; identical to SEQ ID NO: 6760

SEQ ID NO: 7445 - DNA, 50 bp, Homo sapiens; identical to SEQ ID NO: 6761

SEQ ID NO: 7446 - DNA, 50 bp, Homo sapiens; identical to SEQ ID NO: 6762

SEQ ID NO: 7447 - DNA, 50 bp, Homo sapiens; identical to SEQ ID NO: 6763

SEQ ID NO: 7448 - DNA, 50 bp, Homo sapiens; identical to SEQ ID NO: 6764

SEQ ID NO: 7449 - DNA, 50 bp, Homo sapiens; identical to SEQ ID NO: 6765

SEQ ID NO: 7450 - DNA, 50 bp, Homo sapiens; identical to SEQ ID NO: 6766

SEQ ID NO: 7451 - DNA, 50 bp, Homo sapiens; identical to SEQ ID NO: 6767

SEQ ID NO: 7452 - DNA, 50 bp, Homo sapiens; identical to SEQ ID NO: 6768

SEQ ID NO: 7453 - DNA, 50 bp, Homo sapiens; identical to SEQ ID NO: 6769

SEQ ID NO: 7454 - DNA, 50 bp, Homo sapiens; identical to SEQ ID NO: 6770

SEQ ID NO: 7455 - DNA, 50 bp, Human cytomegalovirus; identical to SEQ ID NO: 4173

SEQ ID NO: 7456 - DNA, 50 bp, Human cytomegalovirus
ttttgcgaacttttaggaaccagcaagtcaacaaaagactaacaaagaaa

SEQ ID NO: 7457 - DNA, 50 bp, Homo sapiens; identical to SEQ ID NO: 4181

SEQ ID NO: 7458 - DNA, 50 bp, Homo sapiens; identical to SEQ ID NO: 4174

SEQ ID NO: 7459 - DNA, 50 bp, Human cytomegalovirus; identical to SEQ ID NO: 4177

SEQ ID NO: 7460 - DNA, 50 bp, Human cytomegalovirus; identical to SEQ ID NO: 4182

SEQ ID NO: 7461 - DNA, 50 bp, Human cytomegalovirus; identical to SEQ ID NO: 4179

SEQ ID NO: 7462 - DNA, 50 bp, Human cytomegalovirus; identical to SEQ ID NO: 4183

SEQ ID NO: 7463 - DNA, 50 bp, Human cytomegalovirus; identical to SEQ ID NO: 4175

SEQ ID NO: 7464 - DNA, 50 bp, Human cytomegalovirus; identical to SEQ ID NO: 4184

SEQ ID NO: 7465 - DNA, 50 bp, Human cytomegalovirus
ctgcatcgtcgtcgtcctcctcctctcggagatcgcgacggagaaacaac

SEQ ID NO: 7466 - DNA, 50 bp, Human cytomegalovirus
ctgagcctggccatcgaggcagccatccaggacctgaggaacaagtctca

SEQ ID NO: 7467 - DNA, 50 bp, Human cytomegalovirus; identical to SEQ ID NO: 4178

SEQ ID NO: 7468 - DNA, 50 bp, Human cytomegalovirus; identical to SEQ ID NO: 4180

SEQ ID NO: 7469 - DNA, 50 bp, Human adenovirus type 2
ctgtggaatgtatcgaggacttgcttaacgagtctgggcaacctttggac

SEQ ID NO: 7470 - DNA, 50 bp, Human adenovirus type 2
gctggcctgcacccgcgctgagtttggctctagcgatgaagatacagatt

SEQ ID NO: 7471 - DNA, 50 bp, Human adenovirus type 2
ggggcggttaggctgtcctccttctcgactgactccatgatctttttctg

SEQ ID NO: 7472 - DNA, 50 bp, Human adenovirus type 2
tgtttgccttattattatgtggcttatttgttgcctaaagcgcagacgcg

SEQ ID NO: 7473 - DNA, 50 bp, Homo sapiens
acggtgatcaatataagctatgtggtggtggggctatactactgaatgaa

SEQ ID NO: 7474 - DNA, 50 bp, Human adenovirus type 2
tttctgccctgaaggcttcctcccctcccaatgcggtttaaaacataaat

SEQ ID NO: 7475 - DNA, 50 bp, Human adenovirus type 2
ggcttatgcccatgtatctgaacatccagagtcacctttaccacgtcctg

SEQ ID NO: 7476 - DNA, 50 bp, Human adenovirus type 2
ctactgccgtacagcgaaagccgccccaacccgcgaaacgaggagatatg

SEQ ID NO: 7477 - DNA, 50 bp, Homo sapiens; identical to SEQ ID NO: 7104

SEQ ID NO: 7478 - DNA, 50 bp, Homo sapiens; identical to SEQ ID NO: 7105

SEQ ID NO: 7479 - DNA, 50 bp, Homo sapiens; identical to SEQ ID NO: 7106

SEQ ID NO: 7480 - DNA, 50 bp, Homo sapiens; identical to SEQ ID NO: 7107

SEQ ID NO: 7481 - DNA, 50 bp, Homo sapiens; identical to SEQ ID NO: 7108

SEQ ID NO: 7482 - DNA, 50 bp, Homo sapiens; identical to SEQ ID NO: 7109

SEQ ID NO: 7483 - DNA, 50 bp, Homo sapiens; identical to SEQ ID NO: 7110

SEQ ID NO: 7484 - DNA, 50 bp, Homo sapiens; identical to SEQ ID NO: 7111

SEQ ID NO: 7485 - DNA, 50 bp, Homo sapiens; identical to SEQ ID NO: 7112

SEQ ID NO: 7486 - DNA, 50 bp, Homo sapiens; identical to SEQ ID NO: 7113

SEQ ID NO: 7487 - DNA, 50 bp, Homo sapiens; identical to SEQ ID NO: 7114

SEQ ID NO: 7488 - DNA, 50 bp, Homo sapiens; identical to SEQ ID NO: 7115

SEQ ID NO: 7489 - DNA, 50 bp, Homo sapiens; identical to SEQ ID NO: 7116

SEQ ID NO: 7490 - DNA, 50 bp, Homo sapiens; identical to SEQ ID NO: 7117

SEQ ID NO: 7491 - DNA, 50 bp, Homo sapiens; identical to SEQ ID NO: 7118

SEQ ID NO: 7492 - DNA, 50 bp, Homo sapiens; identical to SEQ ID NO: 7119

SEQ ID NO: 7493 - DNA, 50 bp, Homo sapiens; identical to SEQ ID NO: 7120

SEQ ID NO: 7494 - DNA, 50 bp, Homo sapiens; identical to SEQ ID NO: 7121

SEQ ID NO: 7495 - DNA, 50 bp, Homo sapiens; identical to SEQ ID NO: 7122

SEQ ID NO: 7496 - DNA, 50 bp, Homo sapiens; identical to SEQ ID NO: 7123

SEQ ID NO: 7497 - DNA, 50 bp, Homo sapiens; identical to SEQ ID NO: 7124

SEQ ID NO: 7498 - DNA, 50 bp, Homo sapiens; identical to SEQ ID NO: 7125

SEQ ID NO: 7499 - DNA, 50 bp, Homo sapiens; identical to SEQ ID NO: 7126

SEQ ID NO: 7500 - DNA, 50 bp, Homo sapiens; identical to SEQ ID NO: 7127

SEQ ID NO: 7501 - DNA, 50 bp, Homo sapiens; identical to SEQ ID NO: 7128

SEQ ID NO: 7502 - DNA, 50 bp, Homo sapiens; identical to SEQ ID NO: 7129

SEQ ID NO: 7503 - DNA, 50 bp, Homo sapiens; identical to SEQ ID NO: 7130

SEQ ID NO: 7504 - DNA, 50 bp, Homo sapiens; identical to SEQ ID NO: 7131

SEQ ID NO: 7505 - DNA, 50 bp, Homo sapiens; identical to SEQ ID NO: 7132

SEQ ID NO: 7506 - DNA, 50 bp, Homo sapiens; identical to SEQ ID NO: 7133

SEQ ID NO: 7507 - DNA, 50 bp, Homo sapiens; identical to SEQ ID NO: 7134

SEQ ID NO: 7508 - DNA, 50 bp, Homo sapiens; identical to SEQ ID NO: 7135

SEQ ID NO: 7509 - DNA, 50 bp, Homo sapiens; identical to SEQ ID NO: 7136

SEQ ID NO: 7510 - DNA, 50 bp, Homo sapiens; identical to SEQ ID NO: 6930

SEQ ID NO: 7511 - DNA, 50 bp, Homo sapiens; identical to SEQ ID NO: 7138

SEQ ID NO: 7512 - DNA, 50 bp, Homo sapiens; identical to SEQ ID NO: 7139

SEQ ID NO: 7513 - DNA, 50 bp, Homo sapiens; identical to SEQ ID NO: 7140

SEQ ID NO: 7514 - DNA, 50 bp, Homo sapiens; identical to SEQ ID NO: 7141

SEQ ID NO: 7515 - DNA, 56 bp, Homo sapiens
tctagggcaggaacatggctgcagcatataaaaagaattgaattccatacttttgt

SEQ ID NO: 7516 - DNA, 50 bp, Homo sapiens; identical to SEQ ID NO: 7143

SEQ ID NO: 7517 - DNA, 50 bp, Homo sapiens; identical to SEQ ID NO: 7144

SEQ ID NO: 7518 - DNA, 50 bp, Homo sapiens; identical to SEQ ID NO: 7145

SEQ ID NO: 7519 - DNA, 50 bp, Homo sapiens; identical to SEQ ID NO: 7146

SEQ ID NO: 7520 - DNA, 50 bp, Homo sapiens; identical to SEQ ID NO: 7147

SEQ ID NO: 7521 - DNA, 50 bp, Homo sapiens; identical to SEQ ID NO: 7148

SEQ ID NO: 7522 - DNA, 50 bp, Homo sapiens; identical to SEQ ID NO: 7149

SEQ ID NO: 7523 - DNA, 50 bp, Homo sapiens; identical to SEQ ID NO: 7150

SEQ ID NO: 7524 - DNA, 50 bp, Homo sapiens; identical to SEQ ID NO: 7151

SEQ ID NO: 7525 - DNA, 50 bp, Homo sapiens; identical to SEQ ID NO: 7152

SEQ ID NO: 7526 - DNA, 50 bp, Homo sapiens; identical to SEQ ID NO: 7153

SEQ ID NO: 7527 - DNA, 50 bp, Homo sapiens; identical to SEQ ID NO: 7154

SEQ ID NO: 7528 - DNA, 50 bp, Homo sapiens; identical to SEQ ID NO: 7155

SEQ ID NO: 7529 - DNA, 50 bp, Homo sapiens; identical to SEQ ID NO: 7156

SEQ ID NO: 7530 - DNA, 50 bp, Homo sapiens; identical to SEQ ID NO: 7157

SEQ ID NO: 7531 - DNA, 50 bp, Homo sapiens; identical to SEQ ID NO: 7158

SEQ ID NO: 7532 - DNA, 50 bp, Homo sapiens; identical to SEQ ID NO: 7159

SEQ ID NO: 7533 - DNA, 50 bp, Homo sapiens; identical to SEQ ID NO: 7160

SEQ ID NO: 7534 - DNA, 50 bp, Homo sapiens
tactggcgtcgagcccactgcctcagaagacttcctttcatctgttccta

SEQ ID NO: 7535 - DNA, 50 bp, Homo sapiens
gtttcaagggacatcttcagagccaacatctaccctcggggctttgtgaa

SEQ ID NO: 7536 - DNA, 50 bp, Homo sapiens
ctacagttctaccataaacactcagtccccgtgtacttccctgcacagga

SEQ ID NO: 7537 - DNA, 50 bp, Homo sapiens
tagttgcatgtgacaacagagatcaacgacgagaccctccacagtatccg

SEQ ID NO: 7538 - DNA, 50 bp, Homo sapiens
ttgaccatagaatcaagcctgaggctgtgaagatggtgcaagtgtggaga

SEQ ID NO: 7539 - DNA, 50 bp, Homo sapiens
ctgctgtcttcacccgaatctcccattaccggccctggatcaaccagatc

SEQ ID NO: 7540 - DNA, 50 bp, Homo sapiens
gtcactggaggaccaacccctgctgtccaaaacaccactgcttcctaccc

SEQ ID NO: 7541 - DNA, 50 bp, Human herpesvirus type 4
catgccatgcatatttcaactgggctgtctatttttgacaccagcttatt

SEQ ID NO: 7542 - DNA, 50 bp, Human herpesvirus type 4
gagaagcacctcaacctggagacaattctactgttcaaacagcagcagca

SEQ ID NO: 7543 - DNA, 50 bp, Human herpesvirus type 4
acttgtcagggccattctctctccgggcactgggtcactaggactgtttt

SEQ ID NO: 7544 - DNA, 50 bp, Human herpesvirus type 4
gacagcgtcctagaaaccctggcgaccattgcctccagcgggatagagtg

SEQ ID NO: 7545 - DNA, 50 bp, Human herpesvirus type 4
catcctctggagcctgacctgtgatcgtcgcatcatagaccgccagtaga

SEQ ID NO: 7546 - DNA, 50 bp, Human herpesvirus type 4
gcctccacacgacatcacaccatataccgcaaggaatatcagggatgctg

SEQ ID NO: 7547 - DNA, 50 bp, Homo sapiens
acagccatcctccccttgagagtcatcagaaaaatacattaggaaaatgt

SEQ ID NO: 7548 - DNA, 50 bp, Human herpesvirus type 4
accttcgtcttctgagtctcatgcctcaaaacctagtttgatagacagga

SEQ ID NO: 7549 - DNA, 50 bp, Human herpesvirus type 4
agatggctacccttctgattatgatcctttcgtagaaaatgctcaaatct

SEQ ID NO: 7550 - DNA, 50 bp, Human herpesvirus type 4
atgcatcgccgacaagtcttgaattaggattgtcgaaattagacaaagaa

SEQ ID NO: 7551 - DNA, 50 bp, Human herpesvirus type 4
cgggtgtgttcaatcatcgacggtgacaatcctatctccatctataatcc

SEQ ID NO: 7552 - DNA, 50 bp, Human herpesvirus type 4
gaagagcgaaatgcaatcttctgcttcttcagtagagactttacagtctt

SEQ ID NO: 7553 - DNA, 50 bp, Human herpesvirus type 4
gcacatccatcgcccaaagtgaagtctgcaaggatgccatttattggttg

SEQ ID NO: 7554 - DNA, 50 bp, Human herpesvirus type 4
tctcggtttacctttttgctgttgtggttctttgttcttgctggtttgct

SEQ ID NO: 7555 - DNA, 50 bp, Human herpesvirus 4
tctgaatactctacaaaacgctccttgtctgctcttaaaaccatctgtgt

SEQ ID NO: 7556 - DNA, 50 bp, Human herpesvirus 6
tgaagctgacacctgtgaaactaacttaaacgcatgttcttctgactcag

SEQ ID NO: 7557 - DNA, 50 bp, Human herpesvirus 6
ttctgttttgggccaggaaccgttctataaattgttttattgactacacg

SEQ ID NO: 7558 - DNA, 50 bp, Human herpesvirus 6
taacaccgtccaagaaattttgccgttgtgtccccatacttctctagggc

SEQ ID NO: 7559 - DNA, 50 bp, Human herpesvirus 6
agaagaaggatcagatggagagttgaaaactttagctggtaagtacatga

SEQ ID NO: 7560 - DNA, 50 bp, Human herpesvirus 6
ccgataccggcaagatctgtcgtctggcaaactcgttttccaccttatgg

SEQ ID NO: 7561 - DNA, 50 bp, Human herpesvirus 6
ctgtgggtccctccccctcatctgttattcccttcccctctgccaccgat

SEQ ID NO: 7562 - DNA, 55 bp, Homo sapiens
actacattttaattaaagattaatgggcatattagaagtttctcaaagttaggct

SEQ ID NO: 7563 - DNA, 50 bp, Homo sapiens
aaaaggagtgagctatcatcagtgctgtgaaataaaagtctggtgtgcca

SEQ ID NO: 7564 - DNA, 50 bp, Homo sapiens
aaagccaccactgttcccagtcagcatatacaagctcttaatattctgtt

SEQ ID NO: 7565 - DNA, 50 bp, Homo sapiens
aaatgtgggataacgcgatgactgtgaccctggttggaaattaaacttgt

SEQ ID NO: 7566 - DNA, 50 bp, Homo sapiens
aacacagaaacatttgagcattgtatttctcgcatcccttctcgtgagcg

SEQ ID NO: 7567 - DNA, 50 bp, Homo sapiens
aacctatcaaagcctagcctaagggctgccatctctgtctaaattctagt

SEQ ID NO: 7568 - DNA, 50 bp, Homo sapiens
aactgcatggtatgaattcagagtgtgacttaagggtcaattcaaagcag

SEQ ID NO: 7569 - DNA, 50 bp, Homo sapiens
acagactttgttaatgtaggaaatctctccaagtggaaacgtgctaactt

SEQ ID NO: 7570 - DNA, 50 bp, Homo sapiens
acaggcaattcagtggactataataatagtggagggttgagatgtagagt

SEQ ID NO: 7571 - DNA, 50 bp, Homo sapiens
acaggtcacagtggatttcttttcaaactgacaatgtttaggttttaagc

SEQ ID NO: 7572 - DNA, 50 bp, Homo sapiens
acctcaagcagatgagattcaggtaattgaagaggcagatgaagaggaat

SEQ ID NO: 7573 - DNA, 50 bp, Homo sapiens
accttctacaccactggaaaataacatggaggtttagagccgtgcaaaat

SEQ ID NO: 7574 - DNA, 50 bp, Homo sapiens
actaaactctgaggcctgaagttctgtgatagaccttaaataagtgtcct

SEQ ID NO: 7575 - DNA, 50 bp, Homo sapiens
actggggtggtgatgttttcgttctgttttatttttctaactctgctgac

SEQ ID NO: 7576 - DNA, 50 bp, Homo sapiens
acttcatcataatttggagggaagctcttggagctgtgagttctccctgt

SEQ ID NO: 7577 - DNA, 50 bp, Homo sapiens
agaacgaggaagagaacacaaggaatgattcaagatccaccttgagagga

SEQ ID NO: 7578 - DNA, 50 bp, Homo sapiens
agagaataggctttctaagatgctgcgatcccgttctgctgcccgtaata

SEQ ID NO: 7579 - DNA, 50 bp, Homo sapiens
agcacaagccacgcttcaccaccaagaggcccaacaccttcttctaggtg

SEQ ID NO: 7580 - DNA, 50 bp, Homo sapiens
aggccaatcactgctgactaagaattcattatattggcttagtacacaga

SEQ ID NO: 7581 - DNA, 50 bp, Homo sapiens
agggaagatttctgtatacttgctggagaggaggaatgtgtatagttact

SEQ ID NO: 7582 - DNA, 50 bp, Homo sapiens
agttttaataccttaagctttttcaagacctaactgcagccgctttggga

SEQ ID NO: 7583 - DNA, 50 bp, Homo sapiens
atgtgctgtaaagtttcttctttccagtaaagactagccattgcattggc

SEQ ID NO: 7584 - DNA, 50 bp, Homo sapiens
attgtgggtggctctgtgggcgcatcaataaaagccgtccttgattttat

SEQ ID NO: 7585 - DNA, 50 bp, Homo sapiens
atttgagtgttgttggaccatgtgtgatcagactgctatctgaataaaat

SEQ ID NO: 7586 - DNA, 50 bp, Homo sapiens
caagcccacccagccgcacacaggcctagaggtaaccaataaagtattag

SEQ ID NO: 7587 - DNA, 50 bp, Homo sapiens
caccagagacaagcagagtaacaggatcagtgggtctaagtgtccgagac

SEQ ID NO: 7588 - DNA, 50 bp, Homo sapiens
caggaggtagggatctggctgagagggaataatctgagcaaaggtatgaa

SEQ ID NO: 7589 - DNA, 50 bp, Homo sapiens
cagtccctctcccaggaggaccctagaggcaattaaatgatgtcctgttc

SEQ ID NO: 7590 - DNA, 50 bp, Homo sapiens
catgagaagtatctgcaataaccccaagtcaacatttaggtttgtgtaca

SEQ ID NO: 7591 - DNA, 50 bp, Homo sapiens
catgttgagtaggaataaataaatctgatgctgcctcctgaggctgcggg

SEQ ID NO: 7592 - DNA, 50 bp, Homo sapiens
ccaccacctctgtggcattgaaatgagcacctccattaaagtctgaatca

SEQ ID NO: 7593 - DNA, 50 bp, Homo sapiens
ccatgccgcctcgttggattgtcggaatgtagacagaaatgtactgttct

SEQ ID NO: 7594 - DNA, 50 bp, Homo sapiens
cccaccgctttgtgagccgtgtcgtatgacctagtaaactttgtaccaat

SEQ ID NO: 7595 - DNA, 50 bp, Homo sapiens
cccacgggagactatttcacacaatttaatacaggaagtcgataatgagg

SEQ ID NO: 7596 - DNA, 50 bp, Homo sapiens
ccctccgtgaggaacacaatctcaatcgttgctgaatcctttcatatcct

SEQ ID NO: 7597 - DNA, 50 bp, Homo sapiens
ccgtgtctttccagccctaaaggaagggcagacccgtgtctttccatgcc

SEQ ID NO: 7598 - DNA, 50 bp, Homo sapiens
cctgaagcacttcacctggaattgatgtgtaggcttaaggagtatgtgac

SEQ ID NO: 7599 - DNA, 50 bp, Homo sapiens
cgcaggcaagagcactcatcaagatagatgtgaacaaaacccggaaaatc

SEQ ID NO: 7600 - DNA, 50 bp, Homo sapiens
cgctcaaaggtcactgagacttttgcctcacctaaagagaccaaggctca

SEQ ID NO: 7601 - DNA, 50 bp, Homo sapiens
cggcctcagtccctactctgctttgggatagtgtgagcttcattttgtac

SEQ ID NO: 7602 - DNA, 50 bp, Homo sapiens
ctagtgtgtgcttgccttgtccctcggggtagatgcttagctggcagtat

SEQ ID NO: 7603 - DNA, 50 bp, Homo sapiens
ctttcagattccctctggtctccgtccgaaacgtctacctcttcccaggc

SEQ ID NO: 7604 - DNA, 50 bp, Homo sapiens
gaaattcacaggccagggcacatcttttatttatttcattatgttggcca

SEQ ID NO: 7605 - DNA, 50 bp, Homo sapiens
gactccctcaacaccccaaaactctaaatgccacggtcatctgtttctat

SEQ ID NO: 7606 - DNA, 50 bp, Homo sapiens
gagcagccacaaaactgtaacctcaaggaaaccataaagcttggagtgcc

SEQ ID NO: 7607 - DNA, 50 bp, Homo sapiens
gcagcaaacagagggtcagtcacaggatgttctgacacaccattgtaact

SEQ ID NO: 7608 - DNA, 50 bp, Homo sapiens
gccaacaatgctgaccggtgcttatcctctaagccctgatccacaataaa

SEQ ID NO: 7609 - DNA, 50 bp, Homo sapiens
gccagtgtaatttctgtcaaccacggacgtttgccttcatgtgtagaatt

SEQ ID NO: 7610 - DNA, 50 bp, Homo sapiens
gcccaagcactagtagagatgcgcgatacaggtctagtttcggtaactgt

SEQ ID NO: 7611 - DNA, 50 bp, Homo sapiens
ggccagattttgactcccagattcctttacaaaacgcactcattcattca

SEQ ID NO: 7612 - DNA, 50 bp, Homo sapiens
gggactccccgcgtgataaattattaatgttccgcagtctcactctgaat

SEQ ID NO: 7613 - DNA, 50 bp, Homo sapiens
gggactgcatgggaagcacggaatatagggttagatgtgtgttatctgta

SEQ ID NO: 7614 - DNA, 50 bp, Homo sapiens
ggggttcgtgtctttggcatcaacaaatactgagggatgggttttgggac

SEQ ID NO: 7615 - DNA, 50 bp, Homo sapiens
gggtgacctgttctctagctgtgatcttaccacttcaaatgggtgtaatt

SEQ ID NO: 7616 - DNA, 50 bp, Homo sapiens
ggtgtgaacgggctgacttggtgaattgggcaactccttatagtgttgtg

SEQ ID NO: 7617 - DNA, 50 bp, Homo sapiens
gtaccacttgaatgatttcagtcaattttgaacccctttggaaagaggtg

SEQ ID NO: 7618 - DNA, 50 bp, Homo sapiens
gtgaaaccccgtctctgctaaaaatacaaaaattagctgggcgtggtggc

SEQ ID NO: 7619 - DNA, 50 bp, Homo sapiens
gttctctgggttgtgctttactccacgcatcaataaataattttgaaggc

SEQ ID NO: 7620 - DNA, 50 bp, Homo sapiens
tactgccaactgaccttataaccctctgcaccttcaaaaagattcatggt

SEQ ID NO: 7621 - DNA, 50 bp, Homo sapiens
tcaaacagtgacatctcttgggaaaatggacttaataggaatatgggact

SEQ ID NO: 7622 - DNA, 50 bp, Homo sapiens
tcacttcctctgaactgttactgcctgaatggagtcctggacgacattgg

SEQ ID NO: 7623 - DNA, 50 bp, Homo sapiens
tccacttaatagactctatgtgtgctgaatgttcctgtgtacatatgtgt

SEQ ID NO: 7624 - DNA, 50 bp, Homo sapiens
tcccgcagagtgcagagacaggaagctggagatgtctttataaagtcaca

SEQ ID NO: 7625 - DNA, 50 bp, Homo sapiens
tctaggaccctaggaagcttaactctgtcatcatctcaagtatctgcaca

SEQ ID NO: 7626 - DNA, 50 bp, Homo sapiens
tcttccgccatctcctctgataaacacgaggtgtctgccagcacccagag

SEQ ID NO: 7627 - DNA, 50 bp, Homo sapiens
tgatatgttgatcagccttatgtggaagaactgtgataaaaagaggagct

SEQ ID NO: 7628 - DNA, 50 bp, Homo sapiens
tgcagtatttttcaaacttctggtcgcaaacccattagtagtttgtgaaa

SEQ ID NO: 7629 - DNA, 50 bp, Homo sapiens
tgctgctcttgatcccacctttgctcctgacaaccctcattcaataaaga

SEQ ID NO: 7630 - DNA, 50 bp, Homo sapiens
tggtttgttcatggatgtattctaagagctgagaacagggcctggacaca

SEQ ID NO: 7631 - DNA, 50 bp, Homo sapiens
tgttctgaatgttggtagacccttcatagctttgttacaatgaaaccttg

SEQ ID NO: 7632 - DNA, 50 bp, Homo sapiens
tgttgatggatgaattttggcatgatgactgtactctcaataaaggctga

SEQ ID NO: 7633 - DNA, 50 bp, Homo sapiens
ttcatcctgtgagtgctggggaggaggagtagatacagactgagtgagag

SEQ ID NO: 7634 - DNA, 50 bp, Homo sapiens
ttcattttcctgggaagtcaaggttacatcttgcagaggttgttttgaga

SEQ ID NO: 7635 - DNA, 50 bp, Homo sapiens
ttctaagccgaaccaaatcctttgccttgaaagaacagccctaaagtggt

SEQ ID NO: 7636 - DNA, 50 bp, Homo sapiens
tttgtttgtttgtttcagatagggtctccctctgtcacccaggctgcagt

SEQ ID NO: 7637 - DNA, 50 bp, Homo sapiens
ttttgtaaatcacggacacctcaattagcaagaactgaggggagggcttt

SEQ ID NO: 7638 - DNA, 50 bp, Homo sapiens
cggtgtggaaaatgttgtcctttgagtggcaagaattagaaaaatcttca

SEQ ID NO: 7639 - DNA, 50 bp, Homo sapiens
ctgaaagctgaggatcggagcaagtttctggacgcacttatttccctcct

SEQ ID NO: 7640 - DNA, 50 bp, Homo sapiens
gttggcctcagccctgtgggtctgtctcatgctctccctgttcctctccc

SEQ ID NO: 7641 - DNA, 50 bp, Homo sapiens
tagccatacttagcctcagcaggagcctggcctgtaacttataaagtgca

SEQ ID NO: 7642 - DNA, 50 bp, Homo sapiens
tgagggctgtgctgacctttgagaggatttgaaattgcttcatattgtga

SEQ ID NO: 7643 - DNA, 50 bp, Homo sapiens
tgtgtaagaaaaggcccattacttttaaggtatgtgctgtcctattgagc

SEQ ID NO: 7644 - DNA, 50 bp, Homo sapiens
ttgttggtaggcacatcgtgtcaagtgaagtagttttataggtatgggtt

SEQ ID NO: 7645 - DNA, 50 bp, Homo sapiens
tttctagcttttccgtgtatctaaacacaatttgctacacaagtcactgt

SEQ ID NO: 7646 - DNA, 50 bp, Homo sapiens
actgtggcacatgttttgatcagaaaggtagttctctttgctctggtagt

SEQ ID NO: 7647 - DNA, 50 bp, Homo sapiens
catcttctgccctggtcccctttctcttgatgtggaaagtctgaatgcag

SEQ ID NO: 7648 - DNA, 50 bp, Homo sapiens
cgctctaatactgcattctgtttctccttttgtgccctgattgtaatcca

SEQ ID NO: 7649 - DNA, 50 bp, Homo sapiens
ctggagactggagaagtaattccaccaatgaaagaatttcctgatcaaca

SEQ ID NO: 7650 - DNA, 50 bp, Homo sapiens
tcagtgtttcgttattccatatcagtggcttttactgtcaaagattgtgt

SEQ ID NO: 7651 - DNA, 50 bp, Homo sapiens
tgcatgagagccctaggatttaaaatatgaaatggtggtctgctgtgtga

SEQ ID NO: 7652 - DNA, 50 bp, Homo sapiens
tgtgctaagcctgatgaaatgtgctccttcaatctccatgaaaccatcgt

SEQ ID NO: 7653 - DNA, 50 bp, Homo sapiens
aaatgatctccctttattaccctcccaaaggttaccagcgtttgaattta

SEQ ID NO: 7654 - DNA, 50 bp, Homo sapiens
acacactaatgtaaccattttatgaaggttgaagtggatttatgcaggca

SEQ ID NO: 7655 - DNA, 50 bp, Homo sapiens
atcaggagaatgtcaaagaagtcctttatgtggattgcccgagcttctct

SEQ ID NO: 7656 - DNA, 50 bp, Homo sapiens
attgtgccactgttttccagcctgggcaatacagtgagaccctgtctcaa

SEQ ID NO: 7657 - DNA, 50 bp, Homo sapiens
cgtcaaagtcaatcccaaaacagataagccctatgaggatgtcagcatca

SEQ ID NO: 7658 - DNA, 50 bp, Homo sapiens
acgacttgctcaagagtaaagattatactgctctgtacaggaagcttgca

SEQ ID NO: 7659 - DNA, 50 bp, Homo sapiens
tgttgaggaaaggaaaagggcatttgtctaaacatggattctgagttgta

SEQ ID NO: 7660 - DNA, 50 bp, Homo sapiens
gtggatgagtagggagtgggcgagacagggacgagatgagcagggtcaag

SEQ ID NO: 7661 - DNA, 50 bp, Homo sapiens
ggtgttcgtgttagtgccaagattgcttcgttgtagagagagttcgttcc

SEQ ID NO: 7662 - DNA, 50 bp, Homo sapiens
actagagtccaggtaatagtagtggagatatgtggagagacatgataggt

SEQ ID NO: 7663 - DNA, 50 bp, Homo sapiens
ttcctgtgtgagatttctcgccattcctcaattcaacaaatatgcctttt

SEQ ID NO: 7664 - DNA, 50 bp, Homo sapiens
tatactttgatccctcagcaagttgtcctcactgttgtgtgaacctgttt

SEQ ID NO: 7665 - DNA, 50 bp, Homo sapiens
tttcctgaatactttatgacaactgagtttgccgggtagagtggccgttt

SEQ ID NO: 7666 - DNA, 50 bp, Homo sapiens
aaactagaattccggtttcccaaggtggcttatgacaaccagaatccttt

SEQ ID NO: 7667 - DNA, 50 bp, Homo sapiens
ggcttcccgcctgtgcagtcatttgtatgtgttttatatattggagtgtt

SEQ ID NO: 7668 - DNA, 50 bp, Homo sapiens
acaaaatataaggtgtgactttggatcctgactcaaaccaaccagctgtt

SEQ ID NO: 7669 - DNA, 50 bp, Homo sapiens
tcaaaatccgttactctttccacaacaattgagggtaatggtgttcagtt

SEQ ID NO: 7670 - DNA, 50 bp, Homo sapiens
gccattccggcttctctatttgaaaacagttaccatattccccctcagtt

SEQ ID NO: 7671 - DNA, 50 bp, Homo sapiens
atttggtagagacggggtttcaccttattgcccaggccatcatgtatctt

SEQ ID NO: 7672 - DNA, 50 bp, Homo sapiens
tgtcatttgccctttcccccatatatgtagaattgggtctttttcaactt

SEQ ID NO: 7673 - DNA, 50 bp, Homo sapiens
acagggagagactacacacaagccaacctcaatctcatctttatgccatt

SEQ ID NO: 7674 - DNA, 50 bp, Homo sapiens
tcttctttttgatgtgaattactcttgaaatgccggagaagggacaaatt

SEQ ID NO: 7675 - DNA, 50 bp, Homo sapiens
agatagagtcatattctatttagcttgggacatggcaggtactcagttgt

SEQ ID NO: 7676 - DNA, 50 bp, Homo sapiens
agcctttttgggagtgagggtttatatgatgtctgattctgtaatactgt

SEQ ID NO: 7677 - DNA, 50 bp, Homo sapiens
gcagccctgagcctggaatagatactttttggtcttttggttgtagatgt

SEQ ID NO: 7678 - DNA, 50 bp, Homo sapiens
ccctccctatctttttatgggtaatttgattatacacggtgcttgaatgt

SEQ ID NO: 7679 - DNA, 50 bp, Homo sapiens
tatgtcttcttaccccagcacccctaatttaaaatacagatccctgaggt

SEQ ID NO: 7680 - DNA, 50 bp, Homo sapiens
aaaaccttgacagttcatttcaccaagcacctatcaggtatttggcaggt

SEQ ID NO: 7681 - DNA, 50 bp, Homo sapiens
agtgcccatgctgtttcagatgctcttctagctcctggagatacatcagt

SEQ ID NO: 7682 - DNA, 50 bp, Homo sapiens
tgagcttctgctagtaattccttcaggggatttcctccatggccgtaagt

SEQ ID NO: 7683 - DNA, 50 bp, Homo sapiens
gagggtgtctgctaatgatttccgaaaagttcttcaaaacactccgaagt

SEQ ID NO: 7684 - DNA, 50 bp, Homo sapiens
accagtgtgatgagttttgacaagagacaaaaggaaagggtgggagaagt

SEQ ID NO: 7685 - DNA, 50 bp, Homo sapiens
gctggttgttgcctttcaagacagccaactaccatttattcaacagaagt

SEQ ID NO: 7686 - DNA, 50 bp, Homo sapiens
agtctgtctattctcttctctttagctctgtctgttgctcaaattcaagt

SEQ ID NO: 7687 - DNA, 50 bp, Homo sapiens
gccaaggtgagtcaaaacactgctcttcagaaagcaattatttgaaaagt

SEQ ID NO: 7688 - DNA, 50 bp, Homo sapiens
cattgtccctcccgctgtgctctcaggcaataaatgatttgattatttct

SEQ ID NO: 7689 - DNA, 50 bp, Homo sapiens
ggtcagaaacaggcccacagagactctggagggttcttcctttgtgttct

SEQ ID NO: 7690 - DNA, 50 bp, Homo sapiens
ttcaactgctttggcactgccatgggtacctgaggataagagagatgtct

SEQ ID NO: 7691 - DNA, 50 bp, Homo sapiens
gggttgactaaatgcacatgggcttatctttacctcttccagaaatgtct

SEQ ID NO: 7692 - DNA, 50 bp, Homo sapiens
tgcatgaccagaaacactgcctgatacagtaagcagaggtagctgtctct

SEQ ID NO: 7693 - DNA, 50 bp, Homo sapiens
acctgccagccagcccacaactataaactgtgtgacacccaaatttatct

SEQ ID NO: 7694 - DNA, 50 bp, Homo sapiens
ggtttctgaggtgattctaatatgcagtcatggttaagaacctgtgatct

SEQ ID NO: 7695 - DNA, 50 bp, Homo sapiens
aagccttggaccagcttcccgtttctctcttgtctcctgccaaaagatct

SEQ ID NO: 7696 - DNA, 50 bp, Homo sapiens
acccaaaggatggtgtctcctgtcccagttgaaaaggtttctacctagct

SEQ ID NO: 7697 - DNA, 50 bp, Homo sapiens
tggttgaatacgcaggaacacccacagtacccagggactaataaatagct

SEQ ID NO: 7698 - DNA, 50 bp, Homo sapiens
ttagggcagtggagaatcagggtgtatctaataaattccttcatggagct

SEQ ID NO: 7699 - DNA, 50 bp, Homo sapiens
gcagatgtctgcgtcatggtttattactcctgtgttcgtttcaaggagct

SEQ ID NO: 7700 - DNA, 50 bp, Homo sapiens
tgtctgtatttggagtccagtagtacactgaaaataatcccgtaaaagct

SEQ ID NO: 7701 - DNA, 50 bp, Homo sapiens
ctcccttcccaccatacacacactcccagctcattttgattccttttcct

SEQ ID NO: 7702 - DNA, 50 bp, Homo sapiens
ggtgaaattgactgggttcctctcccacctctctttccgtagcaattcct

SEQ ID NO: 7703 - DNA, 50 bp, Homo sapiens
actaattcccgtgtctggccctgaacatgaagatataatggacgatccct

SEQ ID NO: 7704 - DNA, 50 bp, Homo sapiens
ttaaaggctcaaacctacctcagacactgctctacccatccccatcccct

SEQ ID NO: 7705 - DNA, 50 bp, Homo sapiens
ccctttgtgagaagaagcaggtttcctttcctatggattgatgtgaccct

SEQ ID NO: 7706 - DNA, 50 bp, Homo sapiens
ttctacccatcacacagattcttccacttaataaaatccatcacctacct

SEQ ID NO: 7707 - DNA, 50 bp, Homo sapiens
tcattactgttgtgaaggctcttcaagagagaaagatgaagctgaaacct

SEQ ID NO: 7708 - DNA, 50 bp, Homo sapiens
gctgtccgtgaaagcactctcaagtcaggaactgaactaagaactttact

SEQ ID NO: 7709 - DNA, 50 bp, Homo sapiens
ctcctgtaatcccagcactggagcttgcagtgagccaagatcatgccact

SEQ ID NO: 7710 - DNA, 50 bp, Homo sapiens
ttggtcaccacacctgggtgtctgaatgtcttgtccttctaaaggtaact

SEQ ID NO: 7711 - DNA, 50 bp, Homo sapiens
gcaacaattctttggaaagtgactctctagggtgcggagaatggtgtgat

SEQ ID NO: 7712 - DNA, 50 bp, Homo sapiens
tcatctctgtaggtcttcctaatcctatgcggagccaaatatagacggat

SEQ ID NO: 7713 - DNA, 50 bp, Homo sapiens
ctttgtatttcaaagaaagtagccccttggctctgatattagttgcagat

SEQ ID NO: 7714 - DNA, 50 bp, Homo sapiens; identical to SEQ ID NO: 5265

SEQ ID NO: 7715 - DNA, 50 bp, Homo sapiens
actgggatgagatgagattcaaggcacttttggagggtgtagctagccat

SEQ ID NO: 7716 - DNA, 50 bp, Homo sapiens
aggctgttgctgcacgggcttttcaaaagcgactcattatgaagaagaat

SEQ ID NO: 7717 - DNA, 50 bp, Homo sapiens
gcactccagcctgggcaacaagagcgaaactctgcctccaataaataaat

SEQ ID NO: 7718 - DNA, 50 bp, Homo sapiens
cgggcggtggcggctgcctgggagaagatgaatctttcatgagtgatttg

SEQ ID NO: 7719 - DNA, 50 bp, Homo sapiens
gatggaactcaaggtgctttacgctttcctcagtcttaccaggaggcttg

SEQ ID NO: 7720 - DNA, 50 bp, Homo sapiens
accaaccctatggacaacttgatcttgaacttctagctttcagacctgtg

SEQ ID NO: 7721 - DNA, 50 bp, Homo sapiens
aatgtagctgacattggagccaccgcccatagaagaaggctaaaactgtg

SEQ ID NO: 7722 - DNA, 50 bp, Homo sapiens
cttcactgacgatctgagacactaggcaggttggaaagggtggagtggtg

SEQ ID NO: 7723 - DNA, 50 bp, Homo sapiens
gcccctggtggttggaaaagtgttctgaatccaataaaaggaaagcggtg

SEQ ID NO: 7724 - DNA, 50 bp, Homo sapiens
caacagtggcaagagtagccagcccataggacggaatgaaaatcaaggtg

SEQ ID NO: 7725 - DNA, 50 bp, Homo sapiens
catccttagatgccagtcttcactttgggtattttcctgcctcctcagtg

SEQ ID NO: 7726 - DNA, 50 bp, Homo sapiens
accaacagtaccgttattgccaccacaagtaaaccagtccctcacttctg

SEQ ID NO: 7727 - DNA, 50 bp, Homo sapiens
aggctaaatcagagctttcctccccagataaaggaaattttccctccctg

SEQ ID NO: 7728 - DNA, 50 bp, Homo sapiens
aacttccagaggcaggagattagacagggatgacagttaaggggttactg

SEQ ID NO: 7729 - DNA, 50 bp, Homo sapiens
acctcttcgttgtattttacctttcacttacaaacaagctcatgccactg

SEQ ID NO: 7730 - DNA, 50 bp, Homo sapiens
gatcaaaacaaggtccttgactttttgcaggggcagcctggcaatcaatg

SEQ ID NO: 7731 - DNA, 50 bp, Homo sapiens
cctaaatgttgtccctcagagatgcacagatgtatatgggtaaggaaatg

SEQ ID NO: 7732 - DNA, 50 bp, Homo sapiens
ccaaccatagtcatgaagctgcttctgttcccaatgcaatcccattgtgg

SEQ ID NO: 7733 - DNA, 50 bp, Homo sapiens
gcttttcaatgcttccgaaactgagtgctaacaggggcaattagtgctgg

SEQ ID NO: 7734 - DNA, 50 bp, Homo sapiens
agttcttgtaacagttaaaactttcttgccagctctcaggttatcactgg

SEQ ID NO: 7735 - DNA, 50 bp, Homo sapiens
gtgtgtaaatgagtgtcagatcttttcttgaaaacaggtttggattgggg

SEQ ID NO: 7736 - DNA, 50 bp, Homo sapiens
agggtccacaaggagaatattttcttaaagtaactccctgatttgcgggg

SEQ ID NO: 7737 - DNA, 50 bp, Homo sapiens
gctcccctatgcctgtgtagcagaatctaaaagataatcatgtgaacggg

SEQ ID NO: 7738 - DNA, 50 bp, Homo sapiens
ttgtcttgtttcttttatctcccctatgtttcatcttagtgcaggcaggg

SEQ ID NO: 7739 - DNA, 50 bp, Homo sapiens
acagttgcctttgagattcctgtatttctgcatgaataaatccataaggg

SEQ ID NO: 7740 - DNA, 50 bp, Homo sapiens
gtccttggaaggtaacacttgtgattggaaccactcttcaagctgaacgg

SEQ ID NO: 7741 - DNA, 50 bp, Homo sapiens
attcattcattcattcaacaagcacttaaaaacaatgcctgtgtgccagg

SEQ ID NO: 7742 - DNA, 50 bp, Homo sapiens
cacacccagccccattcacaaaggactataaaatctacaccccagtcacg

SEQ ID NO: 7743 - DNA, 50 bp, Homo sapiens
ggcatagtagtgctaaacagaggtggaagtagtgaagggagttttgaacg

SEQ ID NO: 7744 - DNA, 50 bp, Homo sapiens
ctagtcctgcccccacctccccaagtattacccctcctaagtcctgctag

SEQ ID NO: 7745 - DNA, 50 bp, Homo sapiens
agataagcaggataaacaagacaggttggattgtgatcagctctatggag

SEQ ID NO: 7746 - DNA, 50 bp, Homo sapiens
gatggctaggacaagatgatttacaagagcgtggcgggagggacggcgag

SEQ ID NO: 7747 - DNA, 50 bp, Homo sapiens
ccgtgtctggattgtgtgtcttacttctaaaggtgcacatacttcataag

SEQ ID NO: 7748 - DNA, 50 bp, Homo sapiens
gtatctctgcacctcactactacccttcactccttggagacctgggcaag

SEQ ID NO: 7749 - DNA, 50 bp, Homo sapiens
aacacaccaccaaacattcttcccatccttcttcaccaaccagctacaag

SEQ ID NO: 7750 - DNA, 50 bp, Homo sapiens
acaattggagttggggctgtcaccacctgaagtgtgtcaaccacagaaag

SEQ ID NO: 7751 - DNA, 50 bp, Homo sapiens
ttagggcaaaagtcctagtggcggcagctttcttgtctagaccctggttc

SEQ ID NO: 7752 - DNA, 50 bp, Homo sapiens
agtgatgcttgccttttcgctttcctaaagatgtcatttgaaaacaagtc

SEQ ID NO: 7753 - DNA, 50 bp, Homo sapiens
cccagcttcattaatgtgaatggtggcagacacctctagctatagagctc

SEQ ID NO: 7754 - DNA, 50 bp, Homo sapiens
gagccaagattgggccactgcactccagcctgggtgacagagtgagactc

SEQ ID NO: 7755 - DNA, 50 bp, Homo sapiens
gagccgagattgcatcactgcactccagcctggtcaacagagcgagactc

SEQ ID NO: 7756 - DNA, 50 bp, Homo sapiens
ttcagtcatgcagcaacatccgcttaatgcctcctaagtgcagaacactc

SEQ ID NO: 7757 - DNA, 50 bp, Homo sapiens
ggtcctcttctctctactctccctagtaactaaccaccaaagcctaaatc

SEQ ID NO: 7758 - DNA, 50 bp, Homo sapiens
ttgtttgtttgtttatttatttattttgaggcagcgtcttgctctgttgc

SEQ ID NO: 7759 - DNA, 50 bp, Homo sapiens
tgccatctttacatctaatcaagaggtagagcttcccctggtgttcctgc

SEQ ID NO: 7760 - DNA, 50 bp, Homo sapiens
tgctctgctcttcccaaatcaaggaatgtagatcttgctaacagaactgc

SEQ ID NO: 7761 - DNA, 50 bp, Homo sapiens
tggcaccaacttacacttccagaagagagtggttcaggaaattactatgc

SEQ ID NO: 7762 - DNA, 50 bp, Homo sapiens
aactttgggaagtgagactctgtcttgggtttttgataataaatgtgggc

SEQ ID NO: 7763 - DNA, 50 bp, Homo sapiens
ccgagaaagtacggctggagcggactggggagacggaaatattgagtcgc

SEQ ID NO: 7764 - DNA, 50 bp, Homo sapiens
cgaagaaagaattggatgcagaattgttgcctaacctgggtgacaagagc

SEQ ID NO: 7765 - DNA, 50 bp, Homo sapiens
agtgcctgtgattccacccccttacctcccactcaagtgacaatgtaagc

SEQ ID NO: 7766 - DNA, 50 bp, Homo sapiens
agaaagttaggagtcggcaaccttaaggaggagtttcctatcatctctcc

SEQ ID NO: 7767 - DNA, 50 bp, Homo sapiens
tgtcacaaagatgaagcaaggtggctcagggaacgtgctcagaaacctcc

SEQ ID NO: 7768 - DNA, 50 bp, Homo sapiens
gcaaagtgaaagttttccctttggccctaaaatatgaaagcaaagcatcc

SEQ ID NO: 7769 - DNA, 50 bp, Homo sapiens
ccctgtccatcttttcctgttcctatccagccttccctctcctttttgcc

SEQ ID NO: 7770 - DNA, 50 bp, Homo sapiens
ccacggagggctccccatctaaagggagtttaataaacaaaggaatggcc

SEQ ID NO: 7771 - DNA, 50 bp, Homo sapiens
caattggtacattctcggcaaacccttgcccacaatttcctcaggaagcc

SEQ ID NO: 7772 - DNA, 50 bp, Homo sapiens
agggtgtccctgtgatttttaaattcactatctagctgtccctatccccc

SEQ ID NO: 7773 - DNA, 50 bp, Homo sapiens
cttatattatgttttctctgtgacaagcacctcacctcccaacccacccc

SEQ ID NO: 7774 - DNA, 50 bp, Homo sapiens
gagaattcaaattaaatgcagagtcctaggcccaccctggcataccaccc

SEQ ID NO: 7775 - DNA, 50 bp, Homo sapiens
acaaccaatgcctcacacttaagctcctagaagtcactagggaccagacc

SEQ ID NO: 7776 - DNA, 50 bp, Homo sapiens
gccctcaccagaattcaatcatgctggcaccttatcttggactttcaacc

SEQ ID NO: 7777 - DNA, 50 bp, Homo sapiens
agggtaagagttccagacctgactggacaataaagtgagactgtctctac

SEQ ID NO: 7778 - DNA, 50 bp, Homo sapiens
ctccgtctgccgcctccgtagccacagcgactttggaagtgatatttgac

SEQ ID NO: 7779 - DNA, 50 bp, Homo sapiens
ccctggagaaggagggtgatttattttcaactttctgatttaccaccgac

SEQ ID NO: 7780 - DNA, 50 bp, Homo sapiens
gattgtttgagcctgggagttccacaccagcctgggctacatagggagac

SEQ ID NO: 7781 - DNA, 50 bp, Homo sapiens
ctgctctagactgagcacagccactgacaggtgaccttcagaatcctcac

SEQ ID NO: 7782 - DNA, 50 bp, Homo sapiens
acccctgctttactgtgacagacatatagtttgtcatacataaaacccac

SEQ ID NO: 7783 - DNA, 50 bp, Homo sapiens
acctaacagaaatttggattcgggttgtctaaatacaccctggtgggtta

SEQ ID NO: 7784 - DNA, 50 bp, Homo sapiens
gcctttcccaccaacagtttatgtgattccctgccctacccttaccatta

SEQ ID NO: 7785 - DNA, 50 bp, Homo sapiens
tcccattgcatgtcccgtatattgaaagctgcctctacttctctctggta

SEQ ID NO: 7786 - DNA, 50 bp, Homo sapiens
ggcaggggatgaaccagataatttccagcccttcttggtagctcttcgta

SEQ ID NO: 7787 - DNA, 50 bp, Homo sapiens
gcttaggagtttgggaccagcctgggtaacatagtgaaaccctgtctcta

SEQ ID NO: 7788 - DNA, 50 bp, Homo sapiens
ttgcagctattttcaagttgtaagaaatgaacttgcaacacatagggcta

SEQ ID NO: 7789 - DNA, 50 bp, Homo sapiens
tctcttgccacagggatttcctccaagctggaatcaccatttccttccta

SEQ ID NO: 7790 - DNA, 50 bp, Homo sapiens
cccacccaccagtaggttgtgattcaactgaaccatttcaggagcaccta

SEQ ID NO: 7791 - DNA, 50 bp, Homo sapiens
gaacccagctaagccacacccagattctgacccagggatactctgaaata

SEQ ID NO: 7792 - DNA, 50 bp, Homo sapiens
gtgtgtgctggcgtgccttataggtgtgcgtgtttccctgtcagttttga

SEQ ID NO: 7793 - DNA, 50 bp, Homo sapiens
aggaaaactcagaaataatttctgccccctggattctctaagatttgtga

SEQ ID NO: 7794 - DNA, 50 bp, Homo sapiens
gtggaaagaatcctacaacgaacactattaaagtctgcacctagatctga

SEQ ID NO: 7795 - DNA, 50 bp, Homo sapiens
ggcctaggttccagcattcagtcatcaagtcttgttacagaaataaatga

SEQ ID NO: 7796 - DNA, 50 bp, Homo sapiens
ccccatttggagtctagtcaaaacagcagcttctttgagttaccattgga

SEQ ID NO: 7797 - DNA, 50 bp, Homo sapiens
aaggcttgtaactgtaggcccttgtactacactgtgctatacctggtaga

SEQ ID NO: 7798 - DNA, 50 bp, Homo sapiens
cactttgggaggcagaggtgagcagatcacttgaggccaggagtttgaga

SEQ ID NO: 7799 - DNA, 50 bp, Homo sapiens
ggatcacttgaagccagcagtttgagaccagcctgggcaataaaatgaga

SEQ ID NO: 7800 - DNA, 50 bp, Homo sapiens
tcagttgtgatgggatttcttgatggatgagatgtgtcgtgtgacagaga

SEQ ID NO: 7801 - DNA, 50 bp, Homo sapiens
cctcctagaactggaaccaagactgctccatcagagttaaaggtgtaaga

SEQ ID NO: 7802 - DNA, 50 bp, Homo sapiens
gctcacccttgcacctccttcccaaatctgctgtcacattttctcaaaga

SEQ ID NO: 7803 - DNA, 50 bp, Homo sapiens
ttcctgtctccatgttgtggtcaagattgccatttgcttcctgagtttca

SEQ ID NO: 7804 - DNA, 50 bp, Homo sapiens
ctggttctagtgcagtctcctcactttcctggtgtttggtttatctttca

SEQ ID NO: 7805 - DNA, 50 bp, Homo sapiens
tgacatgattacctgactgatgtttctcctccattagactgaatgcttca

SEQ ID NO: 7806 - DNA, 50 bp, Homo sapiens
tggcaaaaagcctaacactgactcatcccattctatcagcacaaacttca

SEQ ID NO: 7807 - DNA, 50 bp, Homo sapiens
gtttacaagggatactagttcctggagggacgaaggaggctctgtttgca

SEQ ID NO: 7808 - DNA, 50 bp, Homo sapiens
tcctcaactcggagattcctgtatggagagaatcaatttctatatttgca

SEQ ID NO: 7809 - DNA, 50 bp, Homo sapiens
acatttcttaggtgtgtagtggtgaaggaaaatagtggaagatgtctgca

SEQ ID NO: 7810 - DNA, 50 bp, Homo sapiens
tcaggaggcttgaaaagactcaaggtttctacactatgggaaataaggca

SEQ ID NO: 7811 - DNA, 50 bp, Homo sapiens
gttttcacttgtgatactaactattgtttttctcccccatgccaagagca

SEQ ID NO: 7812 - DNA, 50 bp, Homo sapiens
agccaagggagcatattattctcttattttaaacctctccgtaggcagca

SEQ ID NO: 7813 - DNA, 50 bp, Homo sapiens
agaaggacccctggttgagaaccacggttgtatagaaaggaattgaagca

SEQ ID NO: 7814 - DNA, 50 bp, Homo sapiens
ttgactgccatagccaagagttaatatagttgcgttttcttaaggaagca

SEQ ID NO: 7815 - DNA, 50 bp, Homo sapiens
cttactgtgcttttaggttttgttgctttctgtctgtatgctatgttcca

SEQ ID NO: 7816 - DNA, 50 bp, Homo sapiens
tgcagttaggagtgtggacactctgcccatctccattgaattaaattcca

SEQ ID NO: 7817 - DNA, 50 bp, Homo sapiens
acttgggttctatccccacgataacttgttatgtatatgccaatatccca

SEQ ID NO: 7818 - DNA, 50 bp, Homo sapiens
agctagaaaatgtccctttttcttctttggaggtctttaaccaaggccca

SEQ ID NO: 7819 - DNA, 50 bp, Homo sapiens
atcaccaatcttatttagcactgtggatgccgttttgcaaatgtcaccca

SEQ ID NO: 7820 - DNA, 50 bp, Homo sapiens
tgacttaaggttggaatatctcctactactcccctgtcctccttggacca

SEQ ID NO: 7821 - DNA, 50 bp, Homo sapiens
tgtggtttgcaatggtttactgatgagacagcaaaaatgagacaggacca

SEQ ID NO: 7822 - DNA, 50 bp, Homo sapiens
tggcgagccagtctctggatgggattctgatcaacagaagttctcataca

SEQ ID NO: 7823 - DNA, 50 bp, Homo sapiens
tgcccatcctttgctgtttttctctttcagtcatggcctatttggagaca

SEQ ID NO: 7824 - DNA, 50 bp, Homo sapiens
ctcaaccttggccctaaactaacagtgacagggagttccccagcctcaca

SEQ ID NO: 7825 - DNA, 50 bp, Homo sapiens
tcctgaccgttgacagagagcttttacagaagtcttaggcagtacacaca

SEQ ID NO: 7826 - DNA, 50 bp, Homo sapiens
agtgtgtggcacccagggatcactgtatgagaatttcctgaacaacaaca

SEQ ID NO: 7827 - DNA, 50 bp, Homo sapiens
gctgtaagtcccttccttactcatcttccctctcaaatacaacaacaaca

SEQ ID NO: 7828 - DNA, 50 bp, Homo sapiens
gccagttggcaccatttatgaaacacaccaccttgtaaccactgaattaa

SEQ ID NO: 7829 - DNA, 50 bp, Homo sapiens
tcaacctagcacagtgcctggctgataggtgttgaatatttccactctaa

SEQ ID NO: 7830 - DNA, 50 bp, Homo sapiens
gcaaccctctgcccctgcaaagagatattgtgacaaagatattcactgaa

SEQ ID NO: 7831 - DNA, 50 bp, Homo sapiens
taacattcctggcacagtccctggcatagggtagataataaatggtggaa

SEQ ID NO: 7832 - DNA, 50 bp, Homo sapiens
tctctaaccatcaaggaaggtcaagggccatgtatctcttttagggagaa

SEQ ID NO: 7833 - DNA, 50 bp, Homo sapiens
ttccacaaactcaggtgtgcaagaaacaatgcattactttattttcagaa

SEQ ID NO: 7834 - DNA, 50 bp, Homo sapiens
caggagtttgagaccagcctgggcaacatagtaagtctccatctcttcaa

SEQ ID NO: 7835 - DNA, 50 bp, Homo sapiens
tccctagtcctggagactcgggaactaaaacaatcaattcccctgagcaa

SEQ ID NO: 7836 - DNA, 50 bp, Homo sapiens
tcctcttcattggagacccctccctgtcacagcacaatgtgggtaataaa

SEQ ID NO: 7837 - DNA, 50 bp, Homo sapiens
cagaacaaggcccacagtgtgaaaggtgctgctgaacaaagataaataaa

SEQ ID NO: 7838 - DNA, 50 bp, Homo sapiens
gagtcagcaacactggtcctcttgccttggttgatgcttttgaactgaaa

SEQ ID NO: 7839 - DNA, 50 bp, Homo sapiens
taaggatgtatccctatgggcaggaaacccaattctaagaaacttacaaa

SEQ ID NO: 7840 - DNA, 50 bp, Homo sapiens
gccactgcactccagcctgggcaacagagcgagaccttgactctttaaaa

SEQ ID NO: 7841 - DNA, 50 bp, Homo sapiens
cacaacacccaaaaggctgcattgcataacatgtatttgttgaatgaaaa

SEQ ID NO: 7842 - DNA, 50 bp, Homo sapiens
ggggtccttgctcacagagctcccaagatggtggtgggccacttccaaaa

SEQ ID NO: 7843 - DNA, 50 bp, Homo sapiens
tccctctataggtaaaagacctgtttgtctgaaatgtgtggaacctgtct

SEQ ID NO: 7844 - DNA, 50 bp, Homo sapiens
gctgccgtgtcttttggcattttcagcatgactatatgtttttgtaatgt

SEQ ID NO: 7845 - DNA, 50 bp, Homo sapiens
ccgaaggcccgtgtggcgcttctcctattctgtagagtggtagtttgttt

SEQ ID NO: 7846 - DNA, 50 bp, Homo sapiens
aaagaggtaaacgcaagttctctcttgtaggtcgggctacaggtgacttt

SEQ ID NO: 7847 - DNA, 50 bp, Homo sapiens
tggttctcagcctgggtgaacagagaaggggtctaatttggtcttttgtt

SEQ ID NO: 7848 - DNA, 50 bp, Homo sapiens
tgttcttggcaccctgcactgtcaggctatatcatttctgtttgtttctt

SEQ ID NO: 7849 - DNA, 50 bp, Homo sapiens
tctcattttcttttcctagctgtgatgcaaagtgtcagtggtcccatctt

SEQ ID NO: 7850 - DNA, 50 bp, Homo sapiens
tgtccaaccttccttttgctacaaacaaagaatgcctagggattcaactt

SEQ ID NO: 7851 - DNA, 50 bp, Homo sapiens
caagtggccttggtgtttaaatcttgccctaaattgtaactcacatgatt

SEQ ID NO: 7852 - DNA, 50 bp, Homo sapiens
accaaccagtggtgtgctggagctgtctcatactatcttgagagtccatt

SEQ ID NO: 7853 - DNA, 50 bp, Homo sapiens
agcacttgctttgttccagacattgtccttagctcctttcttgtgtaatt

SEQ ID NO: 7854 - DNA, 50 bp, Homo sapiens
tgcagcaaaaattgaatttcataggccattcagtgttctctgcgataatt

SEQ ID NO: 7855 - DNA, 50 bp, Homo sapiens
ccaggaatggaaatacgccaacccaggttaggcacctctattgcagaatt

SEQ ID NO: 7856 - DNA, 50 bp, Homo sapiens
aggaaattggttgaagtcgtttttctcttgttagtctcatgttaagctgt

SEQ ID NO: 7857 - DNA, 50 bp, Homo sapiens
tcgcctggggagaatttaaaatctaagtcgctggaagtccctttgtatgt

SEQ ID NO: 7858 - DNA, 50 bp, Homo sapiens
acctgtaggaagggtttgtgaatattctgttgctctgaattattagcggt

SEQ ID NO: 7859 - DNA, 50 bp, Homo sapiens
tgagaggatcttgagacattcttgtgttatttgccctctatgttttaggt

SEQ ID NO: 7860 - DNA, 50 bp, Homo sapiens
tcccaagcatgagacaagtaccaccagtggttcaggagatgattttaggt

SEQ ID NO: 7861 - DNA, 50 bp, Homo sapiens
acaagacagcagccttcccgaaatgtcactactaagaattattcagaggt

SEQ ID NO: 7862 - DNA, 50 bp, Homo sapiens
gctgcccaaacttccatttatttaccctccaaacatcacttccttcctct

SEQ ID NO: 7863 - DNA, 50 bp, Homo sapiens
acatttgccaatgcacttgatgtaaagttgttgaggatgttgactctcct

SEQ ID NO: 7864 - DNA, 50 bp, Homo sapiens
tcccccttcctaacaccaatttgggaacatcactacttgtatattatcct

SEQ ID NO: 7865 - DNA, 50 bp, Homo sapiens
tcaagacccttagagtaagttaactcccaaggaaatgtagttagttccct

SEQ ID NO: 7866 - DNA, 50 bp, Homo sapiens
aacccacaatccaactcccttgatgaggatgatcattaacaacaatcact

SEQ ID NO: 7867 - DNA, 50 bp, Homo sapiens
tttgaagcctctggtacttccccttcccaaacccagtcacaggaaacact

SEQ ID NO: 7868 - DNA, 50 bp, Homo sapiens
ttggaggttaacagtattcctttgagtggtgtgattaaaggtgcttttat

SEQ ID NO: 7869 - DNA, 50 bp, Homo sapiens
ccaacctccagaactgcctatctaactcatctgtggtgatggaatgctat

SEQ ID NO: 7870 - DNA, 50 bp, Homo sapiens
agtggctctctgctgttagcatggttactaatcttttggttacttttcat

SEQ ID NO: 7871 - DNA, 50 bp, Homo sapiens
tgacctcagtgtctacttcagcagaacctgtgggtatatgcctacctcat

SEQ ID NO: 7872 - DNA, 50 bp, Homo sapiens
aaggagaactgtcaactgaatctcaaatgcagtcaaatgaagagaggcat

SEQ ID NO: 7873 - DNA, 50 bp, Homo sapiens
ttcaagtcattataggtttgggcatacagggttaaccttgtgatgtacat

SEQ ID NO: 7874 - DNA, 50 bp, Homo sapiens
agcagaacaacatgtgtttgacacttttccttctctgtaatgaggtacat

SEQ ID NO: 7875 - DNA, 50 bp, Homo sapiens
tgcctgtgtgggtcaaaggaatcatctatgctaatgtatttgagccaaat

SEQ ID NO: 7876 - DNA, 50 bp, Homo sapiens
accgaaagcagcattttcaatgtttaattaaatcgatgcaggaaattgtg

SEQ ID NO: 7877 - DNA, 50 bp, Homo sapiens
gtccctggcccttcactcttcgtccaggctctctgacctctttccctctg

SEQ ID NO: 7878 - DNA, 50 bp, Homo sapiens
tgtccgctgttttacctcactgctcctgtttatgcccttaacttctgctg

SEQ ID NO: 7879 - DNA, 50 bp, Homo sapiens
gcacaagacctcacttggaacaagtaccaggcagaagagagcattacctg

SEQ ID NO: 7880 - DNA, 50 bp, Homo sapiens
tttcatatcttggcagttggatgcggtaagagccacagagaaaccacctg

SEQ ID NO: 7881 - DNA, 50 bp, Homo sapiens
aggacccttttcccatatttctggctatatacaaggatatccagacactg

SEQ ID NO: 7882 - DNA, 50 bp, Homo sapiens
accaggcctagaatttaggttctaggtgtaaactattggcctatcagatg

SEQ ID NO: 7883 - DNA, 50 bp, Homo sapiens
gtgcattttagcaacagacttccaggtttccagcgcgggccaggaagggg

SEQ ID NO: 7884 - DNA, 50 bp, Homo sapiens
ctgtcatgcaccacctcatcccctccttcagggccagggacagtccctag

SEQ ID NO: 7885 - DNA, 50 bp, Homo sapiens
agaggaggagggggtagaatgaatttcatttaaagctcaacctagttcag

SEQ ID NO: 7886 - DNA, 50 bp, Homo sapiens
cagtctcccagctttcttggcctcctctgccaactggatgcaaggctcag

SEQ ID NO: 7887 - DNA, 50 bp, Homo sapiens
tggagagaaggttcgggaagacgagggggctgggaggtttggaaagacag

SEQ ID NO: 7888 - DNA, 50 bp, Homo sapiens
ctgaaatgggggaaggtgggttatgacaaagttcatggagaggcctgaag

SEQ ID NO: 7889 - DNA, 50 bp, Homo sapiens
taaagcggtacgggattccgcaccctactccagcaagaaagagcctgaag

SEQ ID NO: 7890 - DNA, 50 bp, Homo sapiens
agcattcattcctccaaacacactcccagggttaggtctcttacctctgc

SEQ ID NO: 7891 - DNA, 50 bp, Homo sapiens
ggtgttgaatatttatacggattggcatcataagataccgcgatacctgc

SEQ ID NO: 7892 - DNA, 50 bp, Homo sapiens
accttagtctaactgccttctgtaaagtgggttgctatagtctttaagcc

SEQ ID NO: 7893 - DNA, 50 bp, Homo sapiens
tgaggtttggatggtggcaggtaaaacagaaaggcaagatgtcatctgac

SEQ ID NO: 7894 - DNA, 50 bp, Homo sapiens
tggagctgctacataattatttcaggtctcaaagcttccaagaagtggac

SEQ ID NO: 7895 - DNA, 50 bp, Homo sapiens
agacggaacctgagatgttggatgttgttgatcttagcaaacagacttta

SEQ ID NO: 7896 - DNA, 50 bp, Homo sapiens
agatctgtaatctttggcaaatggaactcacctgcaacgatacctactta

SEQ ID NO: 7897 - DNA, 50 bp, Homo sapiens
gaggacttccattccccatttcccgcatacctgctgttctgtctgaatta

SEQ ID NO: 7898 - DNA, 50 bp, Homo sapiens
agctcacacctgttccttcatgggtcagttcctttcattttcacttttga

SEQ ID NO: 7899 - DNA, 50 bp, Homo sapiens
agctgctgcttctctttcagttgcaaatgcaaacctgttataatctttga

SEQ ID NO: 7900 - DNA, 50 bp, Homo sapiens
tcaatatctgtgtgtcttttcatgagtggctgttacttgtgaagaattga

SEQ ID NO: 7901 - DNA, 50 bp, Homo sapiens
tgagtggactgaggaatgaatagaaaacgtggatatatgtagaaagctga

SEQ ID NO: 7902 - DNA, 50 bp, Homo sapiens
accagcccctgggaatgttatgagcaaatgatactccatgagtaaaatga

SEQ ID NO: 7903 - DNA, 50 bp, Homo sapiens
tcgtgtgagtgtgagagacatgttcattgtgaaaagatactcctagtgga

SEQ ID NO: 7904 - DNA, 50 bp, Homo sapiens
tttgtcaaatgcctgttcaccatctgtggaagtcattatatgattcagga

SEQ ID NO: 7905 - DNA, 50 bp, Homo sapiens
acacttttcttctaaggagagctttcttaggcatttcaaagaactttcga

SEQ ID NO: 7906 - DNA, 50 bp, Homo sapiens
accaaatgagtaccatctgttgaacacagggtggcgatccaagtgtttca

SEQ ID NO: 7907 - DNA, 50 bp, Homo sapiens
acctgacttccacgataaaatggagatgagtgcaggggtgagtgtatagt

SEQ ID NO: 7908 - DNA, 50 bp, Homo sapiens
tgcagatttatactcctgacgtgtctcattcacagctaaataataggcca

SEQ ID NO: 7909 - DNA, 50 bp, Homo sapiens
accctcgccctttccctccggttcagtacctattgtttctcctttcaaat

SEQ ID NO: 7910 - DNA, 50 bp, Homo sapiens
aagaggaaatggcagaattaaaagcagaaacaagaagatggacatggatt

SEQ ID NO: 7911 - DNA, 50 bp, Homo sapiens
aagagtgtttgagtgcttgtcatcaggtgttttccttaataagtagggat

SEQ ID NO: 7912 - DNA, 50 bp, Homo sapiens; identical to SEQ ID NO: 2584

SEQ ID NO: 7913 - DNA, 50 bp, Homo sapiens
ttccttggattcatttcacttggctagaaattacactgtgctcaatgcct

SEQ ID NO: 7914 - DNA, 50 bp, Homo sapiens
aggtctctgccacctccttctctgtgagctgtcagtctaggttattctct

SEQ ID NO: 7915 - DNA, 50 bp, Homo sapiens
gaataggagggacatggaaccatttgcctctggctgtgtcacagggtgag

SEQ ID NO: 7916 - DNA, 50 bp, Homo sapiens; identical to SEQ ID NO: 507

SEQ ID NO: 7917 - DNA, 50 bp, Homo sapiens
tttcactttcacacttcatctcattcctgttgtcactttccccgaaacga

SEQ ID NO: 7918 - DNA, 50 bp, Homo sapiens
tctggatcaatagcttcccctctagggtctactgatgagtcaaatctaaa

SEQ ID NO: 7919 - DNA, 50 bp, Homo sapiens
tttatctactgtgtgttgtggtggcctgttggaggcaaatagatcagatt

SEQ ID NO: 7920 - DNA, 50 bp, Homo sapiens
gacatttttgtaggatgcctgacgaggtgtagccttttatcttgtttccg

SEQ ID NO: 7921 - DNA, 50 bp, Homo sapiens
cccagtttgtggaagcacaggcaagagtgttcttttctggtgattctcca

SEQ ID NO: 7922 - DNA, 50 bp, Homo sapiens
tgttccttttcctgactcctccttgcaaacaaaatgatagttgacacttt

SEQ ID NO: 7923 - DNA, 50 bp, Homo sapiens
gtgacttgtacattcagcaatagcatttgagcaagttttatcagcaagca

SEQ ID NO: 7924 - DNA, 50 bp, Homo sapiens
ttgctatcgacattcccgtataaagagagagacatatcacgctgctgtca

SEQ ID NO: 7925 - DNA, 50 bp, Homo sapiens; identical to SEQ ID NO: 618

SEQ ID NO: 7926 - DNA, 50 bp, Homo sapiens; identical to SEQ ID NO: 7197

SEQ ID NO: 7927 - DNA, 50 bp, Homo sapiens; identical to SEQ ID NO: 619

SEQ ID NO: 7928 - DNA, 50 bp, Homo sapiens
tgtgattaggttgttttcctgtcatttttgagagactaaaattgtggggg

SEQ ID NO: 7929 - DNA, 50 bp, Homo sapiens; identical to SEQ ID NO: 7260

SEQ ID NO: 7930 - DNA, 50 bp, Homo sapiens
aacaagatgagaacagataaagattgtgtggtgttttggatttggagaga

SEQ ID NO: 7931 - DNA, 50 bp, Homo sapiens
tgtagctcccacaaggtaaacttcattggtaagattgcactgttctgatt

SEQ ID NO: 7932 - DNA, 50 bp, Homo sapiens
tcactcccccatttcacttctttgtcagagaatagttcttgttcatactg

SEQ ID NO: 7933 - DNA, 50 bp, Homo sapiens
tgggagtgacaaacattctctcatcctacttagcctacctagatttctca

SEQ ID NO: 7934 - DNA, 50 bp, Homo sapiens; identical to SEQ ID NO: 648

SEQ ID NO: 7935 - DNA, 50 bp, Homo sapiens
ccccagcctaaagcagggatcagtcttttcttgtggaataaatccttgga

SEQ ID NO: 7936 - DNA, 50 bp, Homo sapiens
tgtggtaatgcctgttttcatctgtaaatagttaagtatgtacacgaggc

SEQ ID NO: 7937 - DNA, 50 bp, Homo sapiens
agatgcttagtccctcatgcaaatcaattactggtccaaaagattgctga

SEQ ID NO: 7938 - DNA, 50 bp, Homo sapiens
aaaactgctcttctgctctagtaccatgcttagtgcaaatgattatttct

SEQ ID NO: 7939 - DNA, 50 bp, Homo sapiens
agctattaggatcttcaacccaggtaacaggaataattctgtggtttcat

SEQ ID NO: 7940 - DNA, 50 bp, Homo sapiens
tcctgcgtctatccatgtggaatgctggacaataaagcgagtgctgccca

SEQ ID NO: 7941 - DNA, 50 bp, Homo sapiens; identical to SEQ ID NO: 4805

SEQ ID NO: 7942 - DNA, 50 bp, Homo sapiens
actgctttgactggtgggtctctagaagcaaaactgagtgataactcatg

SEQ ID NO: 7943 - DNA, 50 bp, Homo sapiens
ggcattgtctctgtttcccagtggggtggacagtatatcagatggtcaga

SEQ ID NO: 7944 - DNA, 50 bp, Homo sapiens
ccctgggctaccatctgcatggggctggggtcctcctgtgctatttgtac

SEQ ID NO: 7945 - DNA, 50 bp, Homo sapiens; identical to SEQ ID NO: 727

SEQ ID NO: 7946 - DNA, 50 bp, Homo sapiens
tcttggcagccatcctttttaagagtaagttggttacttcaaaaagagca

SEQ ID NO: 7947 - DNA, 50 bp, Homo sapiens
agctaaagagagggaacctcatctaagtaacatttgcacatgatacagca

SEQ ID NO: 7948 - DNA, 50 bp, Homo sapiens
gctgagtgctggccctctgcgtcttccttattaaccttgaatcctcatta

SEQ ID NO: 7949 - DNA, 50 bp, Homo sapiens; identical to SEQ ID NO: 768

SEQ ID NO: 7950 - DNA, 50 bp, Homo sapiens
tccgggccaagaatttttatccatgaagactttcctacttttctcggtgt

SEQ ID NO: 7951 - DNA, 50 bp, Homo sapiens
gcagagttcattgttgccccttaacagtttttcctgagtttactgaagaa

SEQ ID NO: 7952 - DNA, 50 bp, Homo sapiens
ttatcaagcagagacctttgttgggaggcggtttgggagaacacatttct

SEQ ID NO: 7953 - DNA, 50 bp, Homo sapiens
gggtatgctgcctctgtaaattcatgtattcaaaggaaaagacaccttgc

SEQ ID NO: 7954 - DNA, 50 bp, Homo sapiens
ttgtctgccccacaatcaagaatgtatgtgtaaagtgtgaataaatctca

SEQ ID NO: 7955 - DNA, 50 bp, Homo sapiens; identical to SEQ ID NO: 2677

SEQ ID NO: 7956 - DNA, 50 bp, Homo sapiens
agcagtttgtgatatagcagaggtttaaatgtaccctccccttttatgca

SEQ ID NO: 7957 - DNA, 50 bp, Homo sapiens
tgatgctgcccattccactgaagttctgaaatctttcgtcatgtaaataa

SEQ ID NO: 7958 - DNA, 50 bp, Homo sapiens; identical to SEQ ID NO: 2256

SEQ ID NO: 7959 - DNA, 50 bp, Homo sapiens; identical to SEQ ID NO: 864

SEQ ID NO: 7960 - DNA, 50 bp, Homo sapiens
gccaggctggttccgcatggtgatctccgtcttgtatgtctgaatgttgg

SEQ ID NO: 7961 - DNA, 50 bp, Homo sapiens
ctatttccaaggcccctccctgtttccccagcaattaaaacggactcatc

SEQ ID NO: 7962 - DNA, 50 bp, Homo sapiens
aaagtgccagaatgactcttctgtgcattcttcttaaagagctgcttggt

SEQ ID NO: 7963 - DNA, 50 bp, Homo sapiens; identical to SEQ ID NO: 7644

SEQ ID NO: 7964 - DNA, 50 bp, Homo sapiens
agtcctgtatcatccatacttgtactaccttgtcctatgaagctctgaga

SEQ ID NO: 7965 - DNA, 50 bp, Homo sapiens
ttggccgcttccctacccacagggcctgacttttacagcttttctctttt

SEQ ID NO: 7966 - DNA, 50 bp, Homo sapiens
tatgacacagcagctcctttgtaagtaccaggtcatgtccatcccttggt

SEQ ID NO: 7967 - DNA, 50 bp, Homo sapiens; identical to SEQ ID NO: 1204

SEQ ID NO: 7968 - DNA, 50 bp, Homo sapiens
tgcatagatgacctttggattattggactctgactattgggaccctaaat

SEQ ID NO: 7969 - DNA, 50 bp, Homo sapiens
tggacgccctaagaaacagagaaaacagaaataacaaccaggaactgctt

SEQ ID NO: 7970 - DNA, 50 bp, Homo sapiens
caatagcttgtgggtctgtgaagactgcggtgtttgagtttctcacaccc

SEQ ID NO: 7971 - DNA, 50 bp, Homo sapiens
tgcactgtactctcttcataggattgtaaaggtgttctaatccaattgca

SEQ ID NO: 7972 - DNA, 50 bp, Homo sapiens
tgaagtcatttcattgggaaggaaagctgcaaagattattgggggactag

SEQ ID NO: 7973 - DNA, 50 bp, Homo sapiens
tttcatctggcccaccctccttagactctcctcccttcaagagttggagc

SEQ ID NO: 7974 - DNA, 50 bp, Homo sapiens
gtgtagaattcggatccagtcatctcacagaactttccactagggtgcca

SEQ ID NO: 7975 - DNA, 50 bp, Homo sapiens
cggaccccagtttcttgtaccaagggggaaacatgcggggaccccaatgg

SEQ ID NO: 7976 - DNA, 50 bp, Homo sapiens; identical to SEQ ID NO: 1511

SEQ ID NO: 7977 - DNA, 50 bp, Homo sapiens
aacacaacactaaaaccgaacacacacgtactaacacacccacgacccaa

SEQ ID NO: 7978 - DNA, 50 bp, Homo sapiens
ccttctggttctgcttttgaccagcatttttgtgcccctctgttactgtg

SEQ ID NO: 7979 - DNA, 50 bp, Homo sapiens
gatatacgaaacacaccactggacgatgcgaaaaacgagacgacataagc

SEQ ID NO: 7980 - DNA, 50 bp, Homo sapiens
tggacaggcatgaaaggttacaaatgggagaaaactcacacacgttatgt

SEQ ID NO: 7981 - DNA, 50 bp, Homo sapiens
gcaggagagcgagagaggagaagaagaggcaggagggagaaagagcgtac

SEQ ID NO: 7982 - DNA, 50 bp, Homo sapiens; identical to SEQ ID NO: 3889

SEQ ID NO: 7983 - DNA, 50 bp, Homo sapiens
agaggaaagaataggaccagtgccgaggtatagggaggagggcatactaa

SEQ ID NO: 7984 - DNA, 50 bp, Homo sapiens
tcggagtaagggcgattgtctcgttaggtaatacatcatcttcgtgcata

SEQ ID NO: 7985 - DNA, 50 bp, Homo sapiens
agacaagacgagcaacgacaaccacagcagctccatacactctgcctctc

SEQ ID NO: 7986 - DNA, 50 bp, Homo sapiens; identical to SEQ ID NO: 2595

SEQ ID NO: 7987 - DNA, 50 bp, Homo sapiens; identical to SEQ ID NO: 1567

SEQ ID NO: 7988 - DNA, 50 bp, Homo sapiens; identical to SEQ ID NO: 1572

SEQ ID NO: 7989 - DNA, 50 bp, Homo sapiens
cgtgccagatataactgtcttgtttcagtgagagacgccctatttctatg

SEQ ID NO: 7990 - DNA, 50 bp, Homo sapiens
tccctgaggcttgtgtatgttggatattgtggtgttttagatcactgagt

SEQ ID NO: 7991 - DNA, 50 bp, Homo sapiens
cagagaagaaacctactacagaggagaagaagcctgctgcataaactctt

SEQ ID NO: 7992 - DNA, 50 bp, Homo sapiens
tcagaacatagatatgtattcagcttgtcttcaaatacggccaagcagaa

SEQ ID NO: 7993 - DNA, 50 bp, Homo sapiens
ttggggtcaagtgaaagggtagggggatagtcctgatcaagtgtgataaa

SEQ ID NO: 7994 - DNA, 50 bp, Homo sapiens; identical to SEQ ID NO: 1626

SEQ ID NO: 7995 - DNA, 50 bp, Homo sapiens
ccttctcttcatgtgtgtaaatctgtaatataccattctctgtggcctgt

SEQ ID NO: 7996 - DNA, 50 bp, Homo sapiens
ggatggcacttccccaccggatggacagttattttgttgataagtaaccc

SEQ ID NO: 7997 - DNA, 50 bp, Homo sapiens
tgagtcagtgtctttactgagctggaagcctctgaaagttattaaaggca

SEQ ID NO: 7998 - DNA, 50 bp, Homo sapiens; identical to SEQ ID NO: 1636

SEQ ID NO: 7999 - DNA, 50 bp, Homo sapiens
gtggcttgctagtctgttacgttaacatgcttttctaaaattgcttcacg

SEQ ID NO: 8000 - DNA, 50 bp, Homo sapiens
ttgtactcactgggctgtgctctcccctgtttacccgatgtatggaaata

SEQ ID NO: 8001 - DNA, 50 bp, Homo sapiens; identical to SEQ ID NO: 2774

SEQ ID NO: 8002 - DNA, 50 bp, Homo sapiens
ttgttgttttccctgatttagcaagcaagtaattttctcccaagctgatt

SEQ ID NO: 8003 - DNA, 50 bp, Homo sapiens
ttagaaacaaaaagagctttccttctccaggaatactgaacatgggagct

SEQ ID NO: 8004 - DNA, 50 bp, Homo sapiens; identical to SEQ ID NO: 2180

SEQ ID NO: 8005 - DNA, 50 bp, Homo sapiens
gatgtctggtgcccaatcccaggaagtgagagccatttcttttgtactgg

SEQ ID NO: 8006 - DNA, 50 bp, Homo sapiens
agttggactaaatgctcttccttcagaggattatccggggcatctactca

SEQ ID NO: 8007 - DNA, 50 bp, Homo sapiens; identical to SEQ ID NO: 1736

SEQ ID NO: 8008 - DNA, 50 bp, Homo sapiens
aaacacatacacacaaaacagcaaacttcaggtaactattttggattgca

SEQ ID NO: 8009 - DNA, 50 bp, Homo sapiens
ctgaggatgagctggaaggagtgagaggggacaaaacccaccttgttgga

SEQ ID NO: 8010 - DNA, 50 bp, Homo sapiens; identical to SEQ ID NO: 7353

SEQ ID NO: 8011 - DNA, 50 bp, Homo sapiens; identical to SEQ ID NO: 1465

SEQ ID NO: 8012 - DNA, 50 bp, Homo sapiens; identical to SEQ ID NO: 1777

SEQ ID NO: 8013 - DNA, 50 bp, Homo sapiens; identical to SEQ ID NO: 4556

SEQ ID NO: 8014 - DNA, 50 bp, Homo sapiens
ggacagcccacagggaggtggtggacggactgtaattgatagattgatta

SEQ ID NO: 8015 - DNA, 50 bp, Homo sapiens
attgaagccgactctggccctggcccttacttgcttctctagctctctag

SEQ ID NO: 8016 - DNA, 50 bp, Homo sapiens
actagactttatgccatggtgctttcagtttaatgctgtgtctctgtcag

SEQ ID NO: 8017 - DNA, 50 bp, Homo sapiens
gagccatatgaaagagaccatgccgtggtcgtgggagtgtacaggccacc

SEQ ID NO: 8018 - DNA, 50 bp, Homo sapiens
ataacagactccagctcctggtccacccggcatgtcagtcagcactctgg

SEQ ID NO: 8019 - DNA, 50 bp, Homo sapiens
ctggcctctgtgtcctagaagggaccctcctgtggtctttgtcttgattt

SEQ ID NO: 8020 - DNA, 50 bp, Homo sapiens
cccaaagctcactttacaaaatatttcctcagtactttgcagaaaacacc

SEQ ID NO: 8021 - DNA, 50 bp, Homo sapiens
atgtctgctagaaagtgttgtagttgattgaccaaaccagttcataaggg

SEQ ID NO: 8022 - DNA, 50 bp, Homo sapiens
ctctgcatgttctgctcttgtgcccttctgagcccacaataaaggctgag

SEQ ID NO: 8023 - DNA, 50 bp, Homo sapiens
tgcatcgtaaaacctttcagaaggaaaggagaatgttttgtggacacgtt

SEQ ID NO: 8024 - DNA, 50 bp, Homo sapiens
agccctattcatgtctctacccactatgcacagattaaacttcacctaca

SEQ ID NO: 8025 - DNA, 50 bp, Homo sapiens
agtgacagtgaacttaagcaaattaccctcctacccaattctatggaata

SEQ ID NO: 8026 - DNA, 50 bp, Homo sapiens
acacatgccctgaatgaattgctaaatttcaaaggaaatggaccctgctt

SEQ ID NO: 8027 - DNA, 50 bp, Homo sapiens
gccactgaaccaatcactttgtatgctatgctcctactgtgatggaaaac

SEQ ID NO: 8028 - DNA, 50 bp, Homo sapiens; identical to SEQ ID NO: 3262

SEQ ID NO: 8029 - DNA, 50 bp, Homo sapiens; identical to SEQ ID NO: 4798

SEQ ID NO: 8030 - DNA, 50 bp, Homo sapiens
gctccatgttctgacttagggcaatttgattctgcacttggggtctgtct

SEQ ID NO: 8031 - DNA, 50 bp, Homo sapiens
gcagcagcttaatttttctgtattgcagtgtttataggcttcttgtgtgt

SEQ ID NO: 8032 - DNA, 50 bp, Homo sapiens; identical to SEQ ID NO: 106

SEQ ID NO: 8033 - DNA, 50 bp, Homo sapiens; identical to SEQ ID NO: 8024

SEQ ID NO: 8034 - DNA, 50 bp, Homo sapiens
acatggaagactaaactcatgcttattgctaaatgtggtctttgccaact

SEQ ID NO: 8035 - DNA, 50 bp, Homo sapiens
agacccctgtgatgcctgtgacctcaattaaagcaattcctttgacctgt

SEQ ID NO: 8036 - DNA, 50 bp, Homo sapiens; identical to SEQ ID NO: 2893

SEQ ID NO: 8037 - DNA, 50 bp, Homo sapiens
ctgtagactcagtgccagccacagcttcagagattgtgctcacatggtat

SEQ ID NO: 8038 - DNA, 50 bp, Homo sapiens
tgacaaaggattttacgtttataaaattatgacagaagccatgtgccccg

SEQ ID NO: 8039 - DNA, 50 bp, Homo sapiens
gtctgccctgctggctggaaacctggtagtgaaacaataatcccagatcc

SEQ ID NO: 8040 - DNA, 50 bp, Homo sapiens
ctcgtcatacaatgcctgatgggctcctgtcaccctccacgtctccacag

SEQ ID NO: 8041 - DNA, 50 bp, Homo sapiens
ctagggagccgcaccttatcatgtaccatcaataaagtaccctgtgctca

SEQ ID NO: 8042 - DNA, 50 bp, Homo sapiens
tccgtatccattacttcgacccacagtactttgaatttgagtttgaggct

SEQ ID NO: 8043 - DNA, 50 bp, Homo sapiens
ccagtcctccacacccaaactgtttctgattggcttttagctttttgttg

SEQ ID NO: 8044 - DNA, 50 bp, Homo sapiens
ctgttgtctctctgaggctgccagttgttgtgtgttaccgatgccagaag

SEQ ID NO: 8045 - DNA, 50 bp, Homo sapiens
aatatagtcaagcaagtttgttccaggtgacccattgagctgtgtatgca

SEQ ID NO: 8046 - DNA, 50 bp, Homo sapiens
tttgctattttcgtcatgcctttgagactgagtcttactccgtcccccag

SEQ ID NO: 8047 - DNA, 50 bp, Homo sapiens; identical to SEQ ID NO: 2117

SEQ ID NO: 8048 - DNA, 50 bp, Homo sapiens
caggaaggaggtaggcacctttctgagcttattctattccccacccacac

SEQ ID NO: 8049 - DNA, 50 bp, Homo sapiens
gggagccatccctctctaccaaggtggcaatgatggagggaacttgcatg

SEQ ID NO: 8050 - DNA, 50 bp, Homo sapiens
tggcccgcaatactgtaggaacaagcatgatcttgttactgtgatatttt

SEQ ID NO: 8051 - DNA, 50 bp, Homo sapiens; identical to SEQ ID NO: 2151

SEQ ID NO: 8052 - DNA, 50 bp, Homo sapiens; identical to SEQ ID NO: 4517

SEQ ID NO: 8053 - DNA, 50 bp, Homo sapiens
tggggactatagtgcaacctatttgggtaaagaaaccatttgctaaaatg

SEQ ID NO: 8054 - DNA, 50 bp, Homo sapiens; identical to SEQ ID NO: 2269

SEQ ID NO: 8055 - DNA, 50 bp, Homo sapiens; identical to SEQ ID NO: 2480

SEQ ID NO: 8056 - DNA, 50 bp, Homo sapiens
gaggaggttgcccagaagaaaaagatatcccagaagaaactgaagaaaca

SEQ ID NO: 8057 - DNA, 50 bp, Homo sapiens
aacctaccagcccttctcccccaataactgtgggtctatacagagtcaat

SEQ ID NO: 8058 - DNA, 50 bp, Homo sapiens
agagagttggaccactattgtgtgttgctaatcattgactgtagtcccaa

SEQ ID NO: 8059 - DNA, 50 bp, Homo sapiens
ccctgtactgctgctgcgacctgatgctgccagtctgttaaaataaagat

SEQ ID NO: 8060 - DNA, 50 bp, Homo sapiens; identical to SEQ ID NO: 2106

SEQ ID NO: 8061 - DNA, 50 bp, Homo sapiens; identical to SEQ ID NO: 106

SEQ ID NO: 8062 - DNA, 50 bp, Homo sapiens; identical to SEQ ID NO: 2926

SEQ ID NO: 8063 - DNA, 50 bp, Homo sapiens
tctctgctcaatctctgcttggctccaaggacctgggatctcctggtacg

SEQ ID NO: 8064 - DNA, 50 bp, Homo sapiens
tgtcttactcaagttcaaacctccagcctgtgaatcaactgtgtctcttt

SEQ ID NO: 8065 - DNA, 50 bp, Homo sapiens; identical to SEQ ID NO: 4159

SEQ ID NO: 8066 - DNA, 50 bp, Homo sapiens
tggtgagtggaatttgacattgtccaaacctttttcatttttgagtgatt

SEQ ID NO: 8067 - DNA, 50 bp, Homo sapiens
gagtgaggaagacccccaagcatagactcgggtactgtgatgatggctgc

SEQ ID NO: 8068 - DNA, 50 bp, Homo sapiens
tggcaaagcccctcacactgcaagggattgtagataacactgacttgttt

SEQ ID NO: 8069 - DNA, 50 bp, Homo sapiens
ggaaaggaaactttgaaccttatgtaccgagcaaatgccaggtctagcaa

SEQ ID NO: 8070 - DNA, 50 bp, Homo sapiens
agttaagattattcagaaggtcggggattggagctaagctgccacctggt

SEQ ID NO: 8071 - DNA, 50 bp, Homo sapiens
ttaccttgtggatgctagtgctgtagagttcactgttgtacacagtctgt

SEQ ID NO: 8072 - DNA, 50 bp, Homo sapiens
ggggtcttcacattatcataacctctcctctaaaggggaggcattaaaat

SEQ ID NO: 8073 - DNA, 50 bp, Homo sapiens
tttccttgtgcaattcagacttaagcatcgagtttttaccatcttccact

SEQ ID NO: 8074 - DNA, 50 bp, Homo sapiens; identical to SEQ ID NO: 3840

SEQ ID NO: 8075 - DNA, 50 bp, Homo sapiens
aaatgtagcttttggggagggaggggaaatgtaatactggaataatttgt

SEQ ID NO: 8076 - DNA, 50 bp, Homo sapiens
acccactgcaaaagtagtagtcaagtgtctaggtctttgatattgctctt

SEQ ID NO: 8077 - DNA, 50 bp, Homo sapiens
gcctgctgtgaactgctttccctcggaatgtttccgtaacaggacattaa

SEQ ID NO: 8078 - DNA, 50 bp, Homo sapiens; identical to SEQ ID NO: 2582

SEQ ID NO: 8079 - DNA, 50 bp, Homo sapiens; identical to SEQ ID NO: 2817

SEQ ID NO: 8080 - DNA, 50 bp, Homo sapiens; identical to SEQ ID NO: 3865

SEQ ID NO: 8081 - DNA, 50 bp, Homo sapiens
ttgggggaaatgttgtgggggtggggttgagttgggggtattttctaatt

SEQ ID NO: 8082 - DNA, 50 bp, Homo sapiens
agcatggtaaacctgggttttgttcatattttctccagacagaaatgcaa

SEQ ID NO: 8083 - DNA, 50 bp, Homo sapiens; identical to SEQ ID NO: 887

SEQ ID NO: 8084 - DNA, 50 bp, Homo sapiens
gcccttgatgctggagtcacatctgttgatagctggagaactttagtttc

SEQ ID NO: 8085 - DNA, 50 bp, Homo sapiens
gccgattccaagcgagggatttaatccttacatttttgcccatttggctc

SEQ ID NO: 8086 - DNA, 50 bp, Homo sapiens
ttccctggacagtttgatgtgcttatggttgagatttataatctgcttgt

SEQ ID NO: 8087 - DNA, 50 bp, Homo sapiens
ggcggtgactgccccagacttggttttgtaatgatttgtacaggaataaa

SEQ ID NO: 8088 - DNA, 50 bp, Homo sapiens
tgaccatttggaggggcggggcctcctagaagaaccttcttagacaatgg

SEQ ID NO: 8089 - DNA, 50 bp, Homo sapiens
cagtcctcacaccagccaaggtcacaggcaagagcaagaagagaaactga

SEQ ID NO: 8090 - DNA, 50 bp, Homo sapiens
cctcagtgatggaatatcatgaatgtgagtcattatgtagctgtcgtaca

SEQ ID NO: 8091 - DNA, 50 bp, Homo sapiens
acacacaacttcagctttgcatcacgagtcttgtattccaagaaaatcaa

SEQ ID NO: 8092 - DNA, 50 bp, Homo sapiens
ggaatttcgcaccagaggacccaccacgtcctcgcttcgacatcttgaac

SEQ ID NO: 8093 - DNA, 50 bp, Homo sapiens; identical to SEQ ID NO: 2067

SEQ ID NO: 8094 - DNA, 50 bp, Homo sapiens
cagagaaagaaaaggcaaaagactggtttgtttgcttaatttccttctgt

SEQ ID NO: 8095 - DNA, 50 bp, Homo sapiens
gaaagcagggaagcagtgtgaactctttattcactcccagcctgtcctgt

SEQ ID NO: 8096 - DNA, 50 bp, Homo sapiens; identical to SEQ ID NO: 7214

SEQ ID NO: 8097 - DNA, 50 bp, Homo sapiens; identical to SEQ ID NO: 75

SEQ ID NO: 8098 - DNA, 50 bp, Homo sapiens; identical to SEQ ID NO: 7278

SEQ ID NO: 8099 - DNA, 50 bp, Homo sapiens
tgcaactagcaactcatcttcggaagacacagccaggagaatgaagtaga

SEQ ID NO: 8100 - DNA, 50 bp, Homo sapiens
gactttcctctctgcgagcttctacttctaagtctgaatccagtcagaaa

SEQ ID NO: 8101 - DNA, 50 bp, Homo sapiens
gtttctctttggttttccagattttctttagaacggtgactgaccctcct

SEQ ID NO: 8102 - DNA, 50 bp, Homo sapiens
ctgagcaataactagcataaccccttggggcctctaaacgggtcttgagg

SEQ ID NO: 8103 - DNA, 50 bp, Homo sapiens
tgcccatttcacattgctcattactcatgcaaatttcttcttgctaacct

SEQ ID NO: 8104 - DNA, 50 bp, Homo sapiens
acccaccattggtaaaatattcaggggaacttggtttaaaagtttatgct

SEQ ID NO: 8105 - DNA, 50 bp, Homo sapiens
gtcaaataaggttgttctttccttgaaggacagcacccatgccacagcac

SEQ ID NO: 8106 - DNA, 50 bp, Homo sapiens
ctggaaaaacatcacatggttgagtcaaggatgaaaagtcaaaactacct

SEQ ID NO: 8107 - DNA, 50 bp, Homo sapiens
atccatccaataaacacagcaacaccctatgctactgaccaagcaaagct

SEQ ID NO: 8108 - DNA, 50 bp, Homo sapiens
tagttagagtccaagacatggttcctccccctttgtctgtacatcctggc

SEQ ID NO: 8109 - DNA, 50 bp, Homo sapiens
cagcctgcctgcttgccatttttcttccccttccatttttctaacctcag

SEQ ID NO: 8110 - DNA, 50 bp, Homo sapiens
acttcctccccctccccctagcattacttatatgatatgtttccataccc

SEQ ID NO: 8111 - DNA, 50 bp, Homo sapiens; identical to SEQ ID NO: 6215

SEQ ID NO: 8112 - DNA, 50 bp, Homo sapiens
tttgcatcccgagttttgtattccaagaaaatcaaagggggccaatttgt

SEQ ID NO: 8113 - DNA, 51 bp, Homo sapiens; identical to SEQ ID NO: 5699

SEQ ID NO: 8114 - DNA, 50 bp, Homo sapiens
aaaaacggtttatgggggtagggaaacaggccgaaaagaacgtggagaaa

SEQ ID NO: 8115 - DNA, 50 bp, Homo sapiens
ggggactcaggcccccgctgggggtcccacatagggtttttatccaaaaa

SEQ ID NO: 8116 - DNA, 50 bp, Homo sapiens; identical to SEQ ID NO: 4235

SEQ ID NO: 8117 - DNA, 50 bp, Homo sapiens; identical to SEQ ID NO: 6061

SEQ ID NO: 8118 - DNA, 50 bp, Homo sapiens; identical to SEQ ID NO: 6136

SEQ ID NO: 8119 - DNA, 50 bp, Homo sapiens
agccatagaaggtgttcaggtattgcactgccaactctttgtccgttttg

SEQ ID NO: 8120 - DNA, 50 bp, Homo sapiens
ccatgcccttgtcatcaatcttgaatcccatagctgcttgaatctgctgc

SEQ ID NO: 8121 - DNA, 50 bp, Homo sapiens
ttaagaatgtggcagaaatgtatgctgaggtagcccagtcaatccttatt

SEQ ID NO: 8122 - DNA, 50 bp, Homo sapiens
atcagtagcaaaacaaacccagcaacttctgtccagcatctgctgtaggg

SEQ ID NO: 8123 - DNA, 50 bp, Homo sapiens
cccatctaactagcacacgaaccttccacgaggacgcctggcgagagaag

SEQ ID NO: 8124 - DNA, 50 bp, Homo sapiens
gaacttggcagttgtagcagaggcagttgaggcttgttgaccatcaccat

SEQ ID NO: 8125 - DNA, 50 bp, Homo sapiens
cgctctctcctgcacagcaccaccaccaacagtctggatgattttaggca

SEQ ID NO: 8126 - DNA, 50 bp, Homo sapiens
ttttgggaagaaaaccctatgcatctgaaatacaattggcaatggaagct

SEQ ID NO: 8127 - DNA, 50 bp, Homo sapiens
ctctttgttgctactcatttctctccggcgtctgctgaggggtaggtgtc

SEQ ID NO: 8128 - DNA, 50 bp, Homo sapiens
caacttcctcttggttacccagaagaacagcagcaccgtgatccagagca

SEQ ID NO: 8129 - DNA, 50 bp, Homo sapiens
ctgtacatctgcatcccagcaaagagcagcagggacaggagggaggagag

SEQ ID NO: 8130 - DNA, 50 bp, Homo sapiens
cacagacagaaggtttcgttcctcattcgacagtggctcattcagctctg

SEQ ID NO: 8131 - DNA, 50 bp, Homo sapiens
tcaagattggcaattcactgtgcccattaaaccactcagtagctcagcct

SEQ ID NO: 8132 - DNA, 50 bp, Homo sapiens
agttgtcctgagagttttacacttgtgagaaaatactggcagctttgatt

SEQ ID NO: 8133 - DNA, 50 bp, Homo sapiens
cacataggaatccttctgacccatgcccaccatcacgccctggtgcctgg

SEQ ID NO: 8134 - DNA, 50 bp, Homo sapiens
aacaggaacctttatctctttgtgaggcgatttgcattctccacacaggc

SEQ ID NO: 8135 - DNA, 50 bp, Homo sapiens
gtacttgccgccggtggcctcattgtagtacacgttgatgcgttccagct

SEQ ID NO: 8136 - DNA, 50 bp, Homo sapiens
atagtggctagggattaggaggcgaaggcgacaggagcagacaccgggtc

SEQ ID NO: 8137 - DNA, 50 bp, Homo sapiens
cattttggcttttaggggtagttttcacgacacctgtgttctggcggcaa

SEQ ID NO: 8138 - DNA, 50 bp, Homo sapiens
ccctggttcaggaattaaggggacagacttgaataagaaacaaaacaaaa

SEQ ID NO: 8139 - DNA, 50 bp, Homo sapiens
acagtagagaatttgagtacacagggtatggagagtagggcacaaaatgt

SEQ ID NO: 8140 - DNA, 50 bp, Homo sapiens
gaacagcctcgtctttccccgaatgccaggcaggatgacgatgaacgtgg

SEQ ID NO: 8141 - DNA, 50 bp, Homo sapiens
gacctccagaatttcctcatcgctgtcggtgaccaagtccacagacacta

SEQ ID NO: 8142 - DNA, 50 bp, Homo sapiens
tcttgccatcctatggaactgcctcggtgagttttctccttcattacaga

SEQ ID NO: 8143 - DNA, 50 bp, Homo sapiens
tgttactccttcaagcccctgaatcactatagccacgactctccaactga

SEQ ID NO: 8144 - DNA, 290 bp, Homo sapiens
  misc_feature (1)..(290): N=A,T,C, or G
agtcaacctaccaaagaccatacctgacacctaggctctctcacccaatggaatagactctaatggtgatacataccaataangggaaatctagtggtggtaaactgtttatgcctcattctatgaaagctgaaagattgctgttagctgtatgatgtataatgctaatcgcgatangggtacattgtcttctacagactcctacatatgtatgattatcacagtatgatgccagatactaacattcatattgaacaaatggctggcgtgggtagatgtcaagagaacat

SEQ ID NO: 8145 - DNA, 386 bp, Homo sapiens
ggcaggtggagaacacaaacgagtgagagctgactgtagtcgaagatcatacaaggaaaggtaagaaggcctgcaagctgtgaattagacataatacattattaattataggatgtaacattatgtatatggggaatatatatctaaacttatttatcaatatttaatattatatatatggggtatgtgtatgtaaacgcatatatattatatatatgtattattaataacttttgtgttatgagactgaatatctataaatatatgttttattaataattactatatgctgtgtaagtatcacgttatattttgtgtgctgactaagtaagcaacgctatgtagatacaaagagttgtgtgatggagtccactggtgatacaacg

SEQ ID NO: 8146 - DNA, 354 bp, Homo sapiens
cgagtacaagctttttttttttattttatttcttgttctggctatgatgacaaactgggtagtatatgatatatataacgtagagaagagtaacatatagacacaaaaaatatatatgagtcatgtattaactagaaatgcacataagataaaatggcctattgaatcatgtttttattatagatatattacaaaatggcattgaaggaaacctacttatttttcaatatgagaacaacagaaggcttttatgtatcacgaaaataacaatatatctgattttataatttataatttacattacataagctgagaactacacaataaaaactcaccaatattgaatattatata

SEQ ID NO: 8147 - DNA, 226 bp, Homo sapiens
atctcgaaggcaactcgcatgcacactagcaacatatataaacaatcttatattagactgtaaatggaaactgtaaagtgattagcttgaatcttttgtgcgaaagatttgtaacagacaatcgggtgaaatcacctcgcgcatgttatggagagattgtgacgttcaggacaaaacgagtaacagactgatcttctgtttgatactacgaccaggactccaggac

SEQ ID NO: 8148 - DNA, 530 bp, Homo sapiens
  misc_feature (1)..(530): N=A,T,C, or G
gacactgagtctaggaatangcacatatggagctaaagacctatgctttaaatactctaaatatatagactacacaaaaacatatgggaaaaatgtactgatgctaagataatattgttgatatcatattgtagaaactataactttaaaccaatagttgtgagcataaatgttacagtgatattgtgtgtaatatatagtacatgtaaaaatgaaactaaatttatatataattgtatatatgacatcaacaatgtaattgatattcttgctgttatcacaacactcgaaattaatgaatgctacagacatggattaaaaagactangctctctaaagagataaagaatattacttaaagcacatattattatgtgtaatacactattagaagattagatctaaactatacaacacanaacgtacttcttttcatcatcctctgctacaaactattgccctcctcaaaatatagacgattgctaaaagagtctgagcgatgatgccatcaatgaacaaacgttttgagt

SEQ ID NO: 8149 - DNA, 514 bp, Homo sapiens
  misc_feature (1)..(514): N = A, T, C, or G
tgtcttggagtaaattttaagttcatggatgtaatgtggtctacaggaatactgtatttgtaaaaaaataagaacattctgcaactgtagaaatgaccccattatatattttctgaaaatgaaaacagttacatgaaaaaaatgaccaatgaacatgtcatcatttgatgaaaaaccagaagttattagatgagagcagcgagtgaatctttaaaacagacttgatcacgcacactcaataagtaatatctctccgaaaccggatgtcattctatatctgttagaaataatgtcatcaaaagaaagtaaattagaggatatttttgccaatagtttatacaaaatatatgaaccaaagagattggaatttgtaaaaatgtaaaatagtatgaacaatatttgcactctaccatatttgaacatctnnatgagttcacattcatactaggttatcaacattgcgttctttttgcattcattctttactgttattaaaagttcaaaaccaatataa

SEQ ID NO: 8150 - DNA, 170 bp, Homo sapiens
  misc_feature (1)..(170): N = A, T, C or G
ccactattatgggatttgttttagtccattatggattctggatattcaancatttacaatgtagcatatttgattttcttttttctttctttttttggcatcattaacatttcatttgaaatgcatattgttcttgaagtacctcggccgcgaccacgctaatcactagt

SEQ ID NO: 8151 - DNA, 162 bp, Homo sapiens
aggcgacagggaatggcaagtttctgaagtcggcatagcttagttgttgcatccagcagagagacagcacagggagcagcctacgcaggaagattacaacagaggaataacacagaatacaatctgggatggataatagtgaatggcatccactagatgatt

SEQ ID NO: 8152 - DNA, 498 bp, Homo sapiens
cagtctttttttttttttttttttttttttttttgggtttggaacctttaataaaaataaaaaaggaatgcaaaaagaacacaatgttgaaaacttaatatgaatgtgaacctcactagatgttcaaatctgggagagtgcaaattttggtcatactattttacatttttacaaactcaaatcactttggttcatatattttctataaactattggcaaaaaaatcctcaaatttacattcttttggctacattatttctaacagatatagatttacttccgggttcggagagaaagacttattgtgtgtgcgtgaacaagtctggtttaaagattcactcgctgctttcatctaataacttctggtttttcataaaatggtgacatcttcattggaaatttttttcatgttactggtttcattttcagaaaaattataagggggggattccaaaggtcagaaagatcctatttttttaaaaaaaaaaaattctggta

SEQ ID NO: 8153 - DNA, 194 bp, Homo sapiens
actattaagttctttcacaaaataatcatcttatatcaacacagtaccaatctaagtgtccgcaggagggttactttaacatctccctcctgtgtttactccaatgtttctccctttaggtatggtctgggtaaatcggtttatggatgcatctgtccacaccacgctcgcagcatgtcactctgcgcattaag

SEQ ID NO: 8154 - DNA, 178 bp, Homo sapiens
gtgcgctggctatggacacgtaaaggaattgccacatggtggacattgattgcaaattgttgaggggatggaaaggatgttggacgttctggtgaaaagctggaagatggccctaaattcttgaagtactggtgaagctgtcattgtcgatttgggtggtggatagcttctgtacgtg

SEQ ID NO: 8155 - DNA, 450 bp, Homo sapiens
caactattatactattctcttctgctttcattctgatgtggtctgtaatagcaaaatacatgacttatttgtgtggatggcaaaacaaaaggtgtgtgttggatggtctgcttatcagtggatgatacaacagtcaagcaaaacctcgcggccctaacccaaaatcgatgaatctttggaacttgaaagacaatctggcctgtatgaatgggcaaacagcgaccatcattcgaaatgaaactggtaggcagtcacatttgacattcatgatcttcactggctactcgtccagactcaaaacgctggtgactgttaacagtgtcaggttttaaccaagcggaattccattaaatatttgccccaatgctctggaaactgggagagaatctttgcactgtgatagctgctacactgtgcgcctgaacacagcgccattggtggtaccccccg

SEQ ID NO: 8156 - DNA, 178 bp, Homo sapiens
tatcatatacataaaacagatggctggggaggaaggaagacaaacaagaatgactcagctggatggacatacacttaatgcatgatcaatcatcaatctgtctgttatacattagttggtgagtgggatgtccatacattaactattgaatgaaaggtaagttatttaatatatttat

SEQ ID NO: 8157 - DNA, 226 bp, Homo sapiens
ttttttttttttttttttggttttgaacctttaataaaagtaaaaaatgaatgcaaaaagaacacaatgttgaaaacttaatatgaatgtgaacctcactagatgttcaaatctgggagagtgcaaattttgttcatactattttacattttttacaaactcaaatcactttggttcatatattttctattaactattggcaaaaaaatcctcaaactctcattcc

SEQ ID NO: 8158 - DNA, 530 bp, Homo sapiens
tactgactatggaaacatgaatatatgtaagggccattcatgatatatgaatgagaagagtaagctttcatatggaaaaacacaatcattcaaaaaatgaatgacatgctgatgtatagcaacacgcatcataaaatgaagagtatatcaataacatatctatgcttagataagtactaccttctgtgtattatagaacaataagtgtgcattggttgtactttgcaactaacgcatgggtatcatgggtatgcacccatcatgatggagtctggattaccatcttgcttttggataaaacagatctatttggggcatctacataggattaatagagagagaaagaggatatatgattcataaatcatatatgctctgatcaaatgcaagcatcattaaaaaacatatgctatctataactactcatcagattgctgtgatctatacactctctccacatattaatactgtgaaacttcaactatagcacattactctggatatgcaaagttagcacggtaggacatgaa

SEQ ID NO: 8159 - DNA, 578 bp, Homo sapiens
agcatttaatccaaacaggggttcttagcctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaaatagaaaaagcacttgaagaatattcccaatattcccggtcagcagtatcaaggctgacttgtgttcatgtggagtcattataaattctataaatcaattattccccttcggtcttaaaaatatatttactcataaacatttgtgttttgttgaaaagatggagtttacaaagataccattcttgagtcatggatttctctggtcacagaatggtgtggcatttggaaacgggaataaacaaaattgctgcatcaatgcactgagtgaaggaagagagacagaggatgaagggttttaga

SEQ ID NO: 8160 - DNA, 530 bp, Homo sapiens
ggtgaggtagtatgtgagtgaaataaatggatggaattagtgatatgaataattgaagtttgagaagtagaatggatgggcgtgttgtgattattagtaaaataagatagaagaatgttgtaagaattatatggatggatatgatatgtaggttattattgtaatttatacttttatgaattgtgaataaggaaatatattctatatagattaggagtgaaagaatcaggtttataaagtgaaataattaaatagaatgcagaaatgaagagaaagggatattgtgtaacatattattggaagaataattaaaatatttaatatgtgttataaaagtgaagataaaagtgtatttttatgaacagaattgttatgaaatattatttttacattaaattaaaagtgtattgagtgaatatgttaaggaatatttattggaaatattagagttaggtacaattgaagaaatgtgtgaatgaagaagaggaagtgattactgggtgaaattatagtgaattggaaataattga

SEQ ID NO: 8161 - DNA, 693 bp, Homo sapiens
gcggtggttgtgatcggctatgtgggtagcttggtggtgtggtggcggcagtgaggggctaggatgggtggtaggatatctaggactgagacggagacttgacctccacgatgcaacatccaatgagtatgctatgtgagaaaaatgagagattaacgagctaaatgcagtgtgtatgatgtgtgagaacatcacagatggatgatcgcacaagaggcatttgcatgatatgatcgcttcatagatggaataatcgaactggtgaatatgtatgagctgtgatgaatgttgctgcagaatccatctgttgaaccatgtatatgcaatgtgtgaggaggctagatgaatggatcatatcatgatgatgttaacaatgttgggtgagattgctatggtgacaaatcatgtggatgtatacaggaatatttctggttgctgcggttgacaaccatgggggatcagacaagagaagtagtagagagtgatgttgacatcgatgggggatacgcttataaatgatgaagtggatgacgtgtgcatgtggagcgtatacgatagttactaacgagtttggagcatagtgtgagtattatatattgtcaagttaataacgtggtggatgcattgttatagttgtttattgtgtgaaattgatatctggttataattatggtcataatttgtatcctgtaa

SEQ ID NO: 8162 - DNA, 194 bp, Homo sapiens
atgatagttgtgaaatgattgattggagggtaagttattggttgtttttagatttaggttagaaagaggaggtatgtggataggagtaaataatgtgattggtttattgggtgaaatattatgttttgttgtttggatatatggaggatggtgattttagtttggataatagaggttatataaatgcaatggaa

SEQ ID NO: 8163 - DNA, 466 bp, Homo sapiens
cagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgaagtttgttgaaaagatggaggttacaaagataccattcttgaagc

SEQ ID NO: 8164 - DNA, 672 bp, Homo sapiens
cccttaagattctggacctcttagaaggaaggctcatctatacacttcaaggacatacgggacctgtctttactgtttcattttcaaaaggtggagagctatttgcatcaggaggtgcagacacacaggtcttattatggaggactaactttgatgaattgcattgtaaaggtcttaccaaaagaaatctcaaaagattacattttgattcaccaccacatcttcttgatatctacccaagaacaccacatccccatgaggaaaaagttgagactgtagaaattaatccaaagcttgaggtaatcgatttgcagatctctactccccctgttatggatatcctttcttttgattctaccacaacaacagaaaccagtggtaggactctgccagacaagggtgaagaggcctgtggatatttcttgaacccttccttaatgtcaccagaatgtttgccaacaaccacgaaaaagaaaacagaagacatgagtgacctcccctgtgaaagtcaaaggagcatacctctcgctgtgactgatgctttagagcatattatggaacaactcaatgttttgacacagactgtttcaatcttggagcagcgactgactttgacagaagataagctgaaagactgccttgaaaatcagcaaaagcttttagtgctgtcca

SEQ ID NO: 8165 - DNA, 514 bp, Homo sapiens
  misc_feature (1)..(514): N = A, T, C, or G
ggcttgggctgctggggcaggggcaactggaggcaagcggaaaacgacgattagttctttatgtatgataataaattaatattaatacatatanatatatagatattatgtaaatgttactatgataatggttatcgtttatacgttatcgtaatatcataagatttttatacaaaatcaaaatacgaagactactaacatgaggatggagaaggaaaaaagtttctgaatcttgaccgtggctgaggcggagacgattcttggacttggagctgtatctgtatgtaaatgaacatagaggaatacgactacagaacctaataccaataccaggacaatggctctgcatttaaatgatagtgactgtgactgaatacagtttaagttaattgttgtaggtgattgtgattatattaatgcgatagcgtatattgagatgaagatctaagtgattgtgaacacttgaccttgatgtccctggacacagtgcattagcgtcatttctaggtcacgc

SEQ ID NO: 8166 - DNA, 402 bp, Homo sapiens
  misc_feature (1)..(402): N= A, C, G, or T
ggtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgngagctttgttggtggtattgtattaacgctgggagttttatctattctttacattggatgcaaaaagtattactcagaagaagcattcgtatcgaaccataaatga

SEQ ID NO: 8167 - DNA, 322 bp, Homo sapiens
  misc_feature (1)..(322): N= A, T, C, or G
ttctcccttaaggactttggcaagaataacaagttcattggaatttgactttctgacatagagcagacagccttgccctgtcatgccaggcctttcatgtgaagttaccatttattagctgcttctgtctctccnagggaagatttcccttttataagcctgggccagggggatgatagtaagattccccatgtgataccagagttggaataagctgtagtgagattanggccaggactgtcccattttgattcttgaatggtttctgttacaacttgtcatgggggaaaaagtaacacttattttttttttcctcccttaa

SEQ ID NO: 8168 - DNA, 290 bp, Homo sapiens
tactatgatatgtgaatggaaaagtaggcagctgatgactcaaattaagaattttaattacattgactccaagtctgatattctgatgagtgtcatatagcacttaatgtctgcttcatataatactaccacttattagatatatatagactcaagagcattaacaaaagtagagaaagagtgagtcattatatacctatgagtaaaatatgaaaatgactatatgtgtctgtctgtgtcttgttatcggtgatgcaaatagttaattcttgatggaagctgtcgacgtg

SEQ ID NO: 8169 - DNA, 242 bp, Homo sapiens
  misc_feature (1)..(242): N = A, T, C, or G
cggtggtncatcgcttgntggtgtggttcttatnattaacnccattgtgtatacaggtttccagtcccttggggtacagtagtggttggccagatggttatgtaagtatttggagtcaggtgtataatggattttcgggtgatatggatgtaaagaaaagctttccttgttcacccggacttgaaatcgtggagttttaatagcagatcttcagcaggtgagagaatcacagctgcattcca

SEQ ID NO: 8170 - DNA, 178 bp, Homo sapiens
ctgtcgagaatggaggattcttacgtggacatgagttgcattgttctttgatgctgtaggcttattaaaagtatgtagtgactagtttccaggcacttggaatctgtgttcctatggttggcggcatagcagctagcatttttgatcaccatacagcagggcttcgggtagtcgcgat

SEQ ID NO: 8171 - DNA, 242 bp, Homo sapiens
  misc_feature (1)..(242): N = A, T, C, or G
ccagnaggttatccctgtacctgccctggtgattggccagcgaatcaggtctaaccagcacaactcccacctggaccagccgaaccagctctgagcatgagttgggtcagatctgaaacatcccctgcataaccccagcaagctacctcccctgctaattatggatgctcatctcctgcaagcatcaaccgcattggcagaagcagcaaacccacttcctccttgcttagcatggaccatgg

SEQ ID NO: 8172 - DNA, 722 bp, Homo sapiens
  misc_feature (1)..(722): n = A, T, C or G
gggaccgggaggtgacttagtgctgatactggcaattggnaaagatgagggacgnctgcttgcactccagcatgcggccatttttaattacattgtttcccaagtatgcatattctgnacatgtctatagcacttagtgtctgcttcatataaactaccagttattatatatttatgatgcaagtagttttccaaatgtggtgaaagtctgagtctttttatccccatgggtaaaatctgaatctggctctctgtgtctctctgtgcttgtttattgctggtcagagagtcaattcttgataaaagctgttgacttggctctcacagtttatgcagacattggagagacgatctggttatttcaaacatcacaggatctgagtaagaagacctggttatgaaacaaggctctcataattactagctatgactgttgacaagttaccttttcttgtttacaagttatttggcctctttgaattacttgtaaaatagagatagggattctttcttgatcatggaacatcaaatgaagttatttgatgaaatactttgttatctggaaattataaatatcacttcatgtttattattatttggaatttgggcttctcatggtggcattttctatggtcatttttttcttttcttgcataatggctataaagttagttagacatgcaaacaaatgccctaagtgggaaattttgaataggttaggg

SEQ ID NO: 8173 - DNA, 242 bp, Homo sapiens
ttgtttgcagagtcctcaaatgtatcacagaaaacagttgctgtggaaacttatagtggaccctactgacgcacaagcattaagaagtccacttgctgcatactgtaaggagaacttgctgcatttgggaaatgctgcttaaggcaacacacattacctttgtgacagggctctgtccactggggtgggctgatgcaatctatacagaatgcacatgctgcctttttttcttctttttttgc

SEQ ID NO: 8174 - DNA, 194 bp, Homo sapiens
  misc_feature (1)..(194): n = A, T, C or G
agcacgtaacccatccgatcccccaagattaaggaaaaagagtgggagagcaaatggaagaagcccctgctaacgggatgctaatgagaaatggggagcaggaggctgacaatgaggtagacgaagaagaggaagaaggtggggaggaagaggaggaggaagaagaaggngaaggtgaggggggggggggcggg

SEQ ID NO: 8175 - DNA, 354 bp, Homo sapiens
tttttttttttttttttttttttttgggcttcccaattattttaatgaagggattgggaggaggacatacaaaacggccagatacacagggtagcaggggcttgataatgagataattttcccccacgtgttgggaaaaaaaatactatgtatttttttatgaacactattaaaaaaaaataaacccactcacaacattttggagggactaaaggccaagagaaaccaatggagaatcattatttgggggatgggggggggagtttctggggggcagggggggatgtggacaggcaggggggggtggaggaaccttgcctctggcgggaatgggaaggagggacaaggaacaaa

SEQ ID NO: 8176 - DNA, 603 bp, Homo sapiens
ccccaaataactttcttattgctctgaaagaagaaaagcaatgtaaatcactatgattattgcacaaacaaccagaattctccaacaattttaagtaatctgatcctcttcttggagaaaattgttacctaatagtttttccttatgaatgttattactactggtataaatcaaatttctataaatttcctacttaagtcttaagaactgggttcttcctttgatgttattcatgttcagaaaggaaacaacactttactcttttaggacaattcctagaatctatagtagtatcaggatatattttgctttaaaatatattttggttattttgaatacagacattggctccaaattttcatctttgcacaatagtatgacttttcactagaacttctcaacatttgggaactttgcaaatatgagcatcatatgtgttaaggctgtatcatttaatgctatgagatacattgttttctccctatgccaaacaggtgaacaaacgtagttgttttttactgatactaaatgttggctacctgtgattttatagtatgcacatgtcagaaaaaggcaagacaaatggcctcttggtccccgccg

SEQ ID NO: 8177 - DNA, 354 bp, Homo sapiens
ttattttatttatttggtattatgtttttttattttttttttttttgttatttttttttttttttgttttttttttttttttttttttttgttttttttttttttttttttgtttttgggggggggaataggagagggggggggaggggggggtgatgaagggggggggaaaagaggatttataatataaaaaaagggggaattaaagggggggagagaagttaatgaaaaggaggaaaaaaaaggatatattaataaaaaaaaattggaaaaaagggggagttttttattaagaggggggtatattttggggggaaaaaaatatggggggggggaaaaaaataatagtttggg

SEQ ID NO: 8178 - DNA, 352 bp, Homo sapiens
acggattgaattgactgatgcatgctcacatatgtctaaaaacaatctgtctgcaataacatgtcatgaatgtgtgactgactggtctgtccttgtgcgagctactacctgctgcctgctatcaatctctctaacaacgggtggacacacacccaccgactgctggttgtcttacacagagaggaaggatccttgcaactatctgggagattaatatgtaaccagcaacctgtgtttgcagccagctgtgggaggtcaaacaaacaaaagcatgcaagcatgtgcggactgaaccgagtgatgcgtgcgagagtacctgcctgggcggacggtcgcactctcttactattga

SEQ ID NO: 8179 - DNA, 464 bp, Homo sapiens
gctttttttttttttttttttttttttttttttttttttttttaaaaaactaaggaaattaattgggttcagggaaaaaaccggaaaaaatggtggaaaaaagtggtaaaaaaaggttaacttaaaaaatacaaaaaataccttggggtaaaattttggaaggggggggtatttaaaaaaaacggaaaaaaaaccaaaacctaaaatattgggaaaacaaaatattaacttttttttttttttaataaaggggggggattgtttttggaataaattaaccaaaaaaataaaggtacccctggtttttttaagggaaaattttttattttaatcaaaccctaaaaaaaccttggtaaggttttatcccattttaaggggggaaaaaaagggctaaaagggggaagggaaaatccttggtgggcaaaacggattatgggggcaaggtaattgaaatggaccccaaa

SEQ ID NO: 8180 - DNA, 448 bp, Homo sapiens
tacagttaccattgtacaatttatgaacacatggattaccttatgacaaagcattatatacaccactgtactagatgatgaagtgctaaccactcacatcactagcatgccttctatttatccaaatatttaaaggtgatatttattgtcgaatgggtggggtggtaccaatggtctctagtatggttagtgtgaaaactataaatatggatctttcagtgagctattagtgagcacctaggggctataagatggtttcacttattaatcacaaaatattcattattatggtgaatgttagatatactctctatgtaaattggttagtaaaacgagttagaagatatgatgaatacaaaaaaaataaaaacagacatgcatgggcggtggaggccatgatcttaaggaaaaaaatgttgtgtgagtcgtgtataacattaaatgaatc

SEQ ID NO: 8181 - DNA, 576 bp, Homo sapiens
caagtaaggggttgtacggtgctgcgaggtcgaatagcataccaatattggttgatctgtctgcaacattagaaatatggagatatatactatttatacatatttaacattaaatatatggggaatatatctttagactcatgaaaaagaataatgtattattatatgcatcatttgtgatatgatatatgactgtgacatgaatatatgaattatttgtaatctgtataaccagtgactgctctgcgaatatcactggtttatcgactgggccagctaggctatgagactacgcaggatcatatggggggcgcgctatgcaaccagccgaaacaagaaccactggagaagtgaggtgatactactcgatgactcgacgaacagctatatgtgaggcgatagtatccagtgcactgacggcttgacaatatgcacgcgaatgtgtccagtgctccaagggcatgacataacataaccagaaagtgtcaggcgggcgcgtagaaaacatgccgacaaatgagactgcacgcgtgcggcttcaaaaattgctgacaactgtgaccgctacctgccggt

SEQ ID NO: 8182 - DNA, 160 bp, Homo sapiens
gacaggggggggggggggggcggggggggggggggggggggggggggggggacgggcagaggggacctattggatgcaaaaaagaatatctatataaaaaaaatatagttgtttttttgtggtttagaaccaccagtaacaatgaaaaagtattcaataa

SEQ ID NO: 8183 - DNA, 208 bp, Homo sapiens
cagttgtcaacaatatttggtaagcaaccagacatgtaaatcttctgtagatgctttgtttttcattatggtgcacctgtacacatttcaagttctgttctgacatgtccattattatcactgtgctctttattgtcaagcatatttttttttaccggtctgtaaactgggatagttatcactttctctttttttatttgtttatttg

SEQ ID NO: 8184 - DNA, 160 bp, Homo sapiens
gaagtcttgtgttttactaatgggaaaaaaaaatacagaaaaaagttttgttactcatggctgccccaccgccagcctgggccctaaaaacagcccagcgcctcacttctggcttgggagaaatatttctttgctccttttgggaattcatggcttgatg

SEQ ID NO: 8185 - DNA, 160 bp, Homo sapiens
gaggtcctgcaaaccatctcaagaccaaaataagcgacccggcctatgtccccctgttattgggattgacccacacggcctctacattggcatgcctagttttgcttgcatctggaaagaaaaagaattgaatcgcacgtttctgggtaaaaaagctggg

SEQ ID NO: 8186 - DNA, 528 bp, Homo sapiens
tttttttttttttttttttttttttttttttttttttttaaaattaaaaaggaattattttttttattgccgggttttattaaagggggattttaaattaattcattggagggggtaaaggaaatggagtgggtgggtgggaaaaggcaggggggccaaaaattattacccattaaaattaaaagtggtttgggtgattggtggggttctggtgggttgggttgggtttttgtttttttgggggtgggttttctggtctttgttcttgaccacttttttaaccattggggttgggggataagaaaaaatttttaggcaaggttgggtattaaaaccacaaaaattttggggggaggaaaattaaatttattgttttaaaggagctttcggggagggggggggtttggtttttgttaccgggaggtgggggggtaggggggttaacacgggtctttttattggaaatttaattctcttaaactttcaaaatggttggcgggggaaaaaaaaaatggccgggagggccag

SEQ ID NO: 8187 - DNA, 384 bp, Homo sapiens
ttttttttttttttttttttttttttttttttttttttttttttttttttttttttttttttttttttttttttttttttttttttttttgggggggcaaaaaatttttttttttttttttggggttggaaaaattttttaagggaatttttggggggggaattttggggataagttttaaaaaaaaaaaaaaaagggggggtaatttttgggaatatttaaggaattaaacaaggtttttatattaattttaggggggggtttaaaaatttatttgggttttaaaaaagggtaccattaaaaaaaattgggattggcttttttagggggacttaaagaatttaagggggtttggggggggggaagggggttatataggggagg

SEQ ID NO: 8188 - DNA, 222 bp, Homo sapiens
cttttttttttttttttttttttttttttttttttttttttttttttttttttttttatggggaaatttacctttttttatttttttttaatattgaaaattttaaaaaaggaattatttttcatttggggtcccggccgggggggggggtaggatcacttgagtaatcaggggggcggtggatggggcgctgaggggagaacacaaacacagggcaggggg

SEQ ID NO: 8189 - DNA, 352 bp, Homo sapiens
tcttggtctaatatagggtatgtgtaatgaactgctagactgtatgcggtacatgaactatactagtgatggggtgctggctgcatattgtgtattactaggtctagttctatgtattaatatgctgcattgtggatatggggcaatatattttttggacgcatctctcttattagtatgatttatagtcctctttcgtgtaatgcaataatgaatatctattattagatggtattatttcttatgacctatatcctgtgactgtctctcttactcctttgtccgcggactgattaggcatggctatgtgtttacgtggctttatttctggggccatcctggcagtgcccct

SEQ ID NO: 8190 - DNA, 160 bp, Homo sapiens
agcttttttttttttttatttttttttttaatgtttgggtgtaaatttattaaaagatttgatttataatatttgtaatggtgactgtcaccttttttcctgccttgctactgatgggattattctgcttaatatattttttattagatgtgcaagttaa

SEQ ID NO: 8191 - DNA, 160 bp, Homo sapiens
tactgacatgcatgtactaactagggtctatggcatgacttgcataggctattacatgctgagttggtagcattagactgcatggtatcataataattgaacacaatgctgatgaagaatattatctcgtggtagttagtatatttataggcaagtggga

SEQ ID NO: 8192 - DNA, 480 bp, Homo sapiens
tacaagctttttttttttttttttttttttttttacaagctttttttttttttttttttttttttttttttttttttttttttaaaatatttttatttttattattttggtattaattaaaaatatgaaaaaaaaagtaaaaggggttcctttttggggggaggccaccttgatggcttaaaacaagcttaataaatcgaaaaaaaaaatgggatgccaaaagatggggggggaaaaagggcttgggggttaaaaggcgaaaaagttgggttagggggttgggggggggtaacagagggaaaaaaaaattcagtttaggggaccctaaggggacgggggggggggggggggtgagggacacttggaagggtttttggagggggattggggggggagggtttttgttattgggggagatccgggagggaggggcggggcagggtgggggtccagtggggtaaattttcttaagggcataaa

SEQ ID NO: 8193 - DNA, 240 bp, Homo sapiens
tagagcttttttttttttttttttttttttttttttttaataggttaaaaaaaaatttttattttttttaaggggtgttaaaaattggaataaagaatatgtataatatttgttagtggggggggtttggtgtaatgattgaatatataggaggatgaaagatatttggttgtaaatagataaaattgggagggaaggtggaggggaaagggggaattttaaaaagatatattaaaaaat

SEQ ID NO: 8194 - DNA, 224 bp, Homo sapiens
tattacatggcacgaggacccactgagaacacaacgcctgttgcggaacaagaacacggaatggggctaacaacagactaagtactttattgttaggcggataatatataactcatttggacaggcctgggccatatctctgactatgccctatattggatgcctggcaggggcccaagcccaagaggattctttaccctcggaacagctccccaggcactcag

SEQ ID NO: 8195 - DNA, 192 bp, Homo sapiens
ctaagattgataatttgtgtatgtgatataaacgttttattaccagatgtgtacatttaatgagctatcatttacattataaaggttgtgtgattctttgtattttttaaacacaatttttatattcaaatctgttggagcaatgaaaagatggagagcataaacaggtttttctatgctgatagaccatgg

SEQ ID NO: 8196 - DNA, 288 bp, Homo sapiens
tgatgaaagccaaattgacgcaggatatgaacctgttttgtattgtgataaggttaatattgtgtgcaattttggtgaaatgagagaaaagattgatcgtggttttggttgaaagatggatgatggtgcttgattgttggatgatggggatgatgacattgatgatatggctggtggaaagctgatgtgtggtgatagattcttaaactatggagatgctggtattgttgatgtgggtgatgtgaaacagatgagtgttgagagtgtcataaaatatagaggattaga

SEQ ID NO: 8197 - DNA, 304 bp, Homo sapiens
tttgatttttttgaaatatgttgatatgataatttatgatataatttggaggatagttggttatttttaattttataattacaaaaatattgtaaaaatttgtgtttagtatacatttttaatagttgtatgaaaggtgtatatgaatattataatgaaacatgttagtaagtgtaattaagaatgatatgaatatattttgtgttaatgatataaagaaatatgggattgatatttaaatgaaaatgtttgtattaaggataataatgataaatgttttaaattaatttactttaaaaaatta

SEQ ID NO: 8198 - DNA, 240 bp, Homo sapiens
tcgtgctaatggtggttctgaatgcaatatttgaatattaaatttaaatctatatattattatggaacataatttatatggggaatatattataagactcataactgaaataagtatgtataataaaaagaatatgtgtaatgataatgaatatctattaatatatagtatcagttataagttttatattatgtgagtgtcttaattaattattggttgtctgagtgatttaggcgacgt

SEQ ID NO: 8199 - DNA, 224 bp, Homo sapiens
agttgtatttaaaaaagcataagtatagattgtgttgggtagaaggagaggagaatgagttgatttgttgaagaggagggtgtttgtggatgaagaggagtaagagttgaaagtagaaagttgaatagatagggaagtgttgtgagtaaggaaaagtaaggaaaaggattcattataagagaaaatgttactgagtgaattaataatatgtaagtttggtttca

SEQ ID NO: 8200 - DNA, 704 bp, Homo sapiens
caagctttttttttttttttttttttttttttttggttttgaacctttaataaaagtaaaaaatgaatgcaaaaagaacacaatgttgaaaacttagtatgaatgtgaacctcactagatgttcaaatctggtagagtgcaaattttgttcatactattttacatttttacaaactcaaatcactttggttcatatattttctataaactattggcaaaaaaatcctcaaatttacattcttttggctacattatttctaacagatatagatttacttccggtttcggagagaaagacttattgtgtgtgcgtgatcaagtctgttttaaagattcactcgctgctttcatctaataacttctggtttttcataaaatgctgacatcttcattggaaatttttttcatgtaactgttttcattttcagaaaatatataagggggtcattcccaagttcagaatgatcctatttttttaaaaaacaaaattcctgtaaaacaaattaactccaggaacttaaaatttactccaagacatttccctcaaaacaaagcaaaaaacccagccaagatcgttacatcacaaaaccaaacacaaagaacagcgctcacaggcaagttcctctaagctttcattctgctgactggtggcttccattttaaaggagtctttttatccagccactttcacagaattttataac

SEQ ID NO: 8201 - DNA, 576 bp, Homo sapiens
atgagtgaagataaaatgaccagcagaggaatgcatgtctggtttcagagttgcaggttattatcctgaaccatacatgaacatcataagcgtgagtgtgatgaactgtatcggatagctacaaagcgcacattagaatgcgagtttgatgagttgaaaggaaaaatagattgccggtctgggtagtagttggaagatggttctaaattcttgaattctggtgatgatgactatgttgatatggttatttgggagatattgtgtgttaagagtttatcaaattattcttctttaggtcgatttgcgggtcatgatattaaatatatagtagtagatggtgtaatcataagtagcggaatacagtgatggtggaactggatacgttcgcaactctgctcataaagctcagatagctgaatgaatagtatcacttataggtgcccactaagtcttaatcattggtgagataacaggcgtagaattgtttgtttcatttgggattctatgtatagttataaatgaatggataatgatcacaatgtgtcgtataagcattatagcgagaagagagatgtc

SEQ ID NO: 8202 - DNA, 368 bp, Homo sapiens
ctcatgcaagtgataggtggaactgtcgcctgcagctaaaacagggaagcggaataagatgctgatgctgtgtcgaggtcgatgagcatcctggtagtggtggctgtgcctgcaatatttgaattttaaatctaaatctttttatttatatttaacattattgatatggggaatatatttttatacttatcattaatatatatatttataatttctgcttttgggtaatgaatatgtatatctatttatatttgttttatttattatttctatttactgtgactgtctcacttttttctttggtttctgtctgattagggttgggtatgtgatggcttagttttatggtcagggccgaattggcaggc

SEQ ID NO: 8203 - DNA, 672 bp, Homo sapiens
tttttttttttttttttttttttttttggttttgaacctttaataaaagtaaaaaatgaatggaaaaagaacacaatggtgaaaacttaatatgaatgcgaaccttacttgatggtcaaatctggtagagtgcaaattttggtcatactattttacatttttacaaactcaaatcactttgggtcatatattttctataaactattggcaaaaaaatcctcaaatttacattcttttgggtacattatttctaacagatatagatttacttccgggttcggagagaaagacttattgggtgtgcgtgatcaagtctggtttaaagattcactcgctggtttcatctaataacttctggtttttcataaaatggtgacatcttcattggaaatttttttcatggaactggtttcattttcagaaaatatataaggggggcattccaaagatcagaatgatcctatttttttaaaaaacaaaattcctgtaaaacaaattaactccaggaacttaaaatttactccaagacattttcctcaaaacaaagcaaaaaaacccaacaaagatcgctatatcacaaaaccaaacacaaagaccagcgctcacagggaagttcctcttaactttcattctgctgactggggggcttcatttaaaaagggtgttttaatg

SEQ ID NO: 8204 - DNA, 288 bp, Homo sapiens
  misc_feature (1)..(288): n = A, T, C, or G
catgagtccgcncagtgcggtaaaaattgntggaaaatctgacctgtggagtgccttacatatgtacttgaatagaagtggtcaataagattgattgcatactgcattggaaaaagacataaagaatgcttgacctatctatttatcctctctcatgatgtcttcgtntagaaaagttaaatatgctgttataagctcatagtttgcaattgcggatagtctcatgagagcttgatggatgaaggctagtaatctgtggtataagccatctggggaacgaggacagga

SEQ ID NO: 8205 - DNA, 160 bp, Homo sapiens
actgctgaacctttttatgttggttacttgtctatatatgctatcttttggtagtctttgctagcttttgatattgtgactgacaaaggtctgtggagtgtctatgagctccagcgtgacaacactgcctgctggcagcttggccagtgctcactcaaaa

SEQ ID NO: 8206 - DNA, 255 bp, Homo sapiens
  misc_feature (1)..(255): n = A, C, T or G
cagcttttttttttttttttttttttttttttttttttattttttaaaacaagcaaatttttattaaaggaaaaattttgcgagttttaaggtttgcgaggtgtaaattttgtgagggtgaaaaggtttactttttcacncagtctgtttctggcatgtcttttaatggatgtcagaagtccacctggtatcaatgtatatgccagtggtgcacactcttgtagttattttcccgcatgtctgtgcgccagtttt

SEQ ID NO: 8207 - DNA, 192 bp, Homo sapiens
  misc_feature (1)..(192): n = A, C, T, or G
tgttcgtgcggacaagnttgtggcgtacagcaaaaagcacccaccaaggcaagacagctgacttcatctgctcatntgtattatcctgcaaccatcctagtgcaaataaagcgccggactatgacctgctggtattgggattgagcacacgtgtctcacattgatatgtcaagtgttgactgaggctgagag

SEQ ID NO: 8208 - DNA, 224 bp, Homo sapiens
ttcccctttttttttttttttttttttttttttagggttttattttaaatgggaagggaaaaattaaaagttaagggaacattaaagtggaaaaaaaaagggaaacacttaaccccaacttttttgaaaaagaaaaaatgatgggggggggagaaaaggtaaggggggaaaaagggtatggggggattggggggggggggacgtgggaggaaaggggagggagg

SEQ ID NO: 8209 - DNA, 752 bp, Homo sapiens
ttatgaggtagatccttgcttgaaagtatctgctgaaaagcccagtaacgtggcagcttcatgcataaagatataaatgacatttgccttaaatttggcagcctaccctggcttgggtcagattttgttgttgaacacaagaaagtatttaagcaaagaaacacttcagtttaattgaaaacaactttttgtaatgctgacgtgttaaattggcctgagggtattaattgatatctgttgattttgtttttctttgaagtataacattactttttggagggaatttttgaaagatgctttcgatttctctcaattctttaagtcatgcaaaatgaatttaaaatccagggagtatggatgcattgccttagttttgatgagctttaaattaaatgtgtgcaatatcaaaatattcaaacttacaagctgggtaaatacatttcctgattaatatcttagtgcttaattgttcccacattttcaaatttgactttactcttttttggcgtaattcagtaagattgttaccagccagtgtgtttgcacacatttgggttgtgtctagatgagttagggacagtcataaaagctggggatatgtcgcatttgcaatcagtagtagcatatttccagaatatgagccataaggtgcagtcctgaatacaacagtgttatccatagaaaggagctttctgacaaatatacatagccttactaatgagtacccctgcgccctccctcccaccgcacct

SEQ ID NO: 8210 - DNA, 368 bp, Homo sapiens
ttttttttttttttttttttttttttggttatttctatttttttttgtctttttgtataggctaatttgtcggatttggggatgagatattgaagggttgaaaggattatatactgtattggtggttggttggttggttgttgggctgggggaaggggggggaggtgggaaattaattaataaaatagtaataaggtcttagataaatattatagttaaagggaggaggggggggggtagggggataaaggggcaattgtgaaggggggatgggtggatgtttttgtggagctgtgggagtgaggatgttaaaatgatttatttttataggtaggagggtgggggggtggtgggtgttacgtggcggg

SEQ ID NO: 8211 - DNA, 690 bp, Homo sapiens
atgtggtgtgtggtggacacaaagttcatttttattttctttttcctttattttttcttatggtgaatgatggaagattaccgattaattacacatggcacatggataatggatgttggctgtcatattcaattgcaatttgttatagtgctgtgtgattaagtattgtttattgactattatttattctatatggtatataagaaggaagcaggaatgttagctgatgacacgtgaatatttattatacatgctgtgtgctgcgtccatgttgattgcttatgacgtatggcgtatggaacatttttaagtcattcttgatggtagctgatacctgatctgtgtgttgagttatcctgtatgtggatcatattttaaactggattacgtgttactggtttgggtgtgggttgtgaaccacaccagagatcactaaacttgcttcaggtttagtatctgactggtgtatggattcttaagcgccataagtcatttgagtatttgattatctgaataataacatgcaaattagcaagaactgggcatacagggtaagcggcaaggacaataaggatttttgtagatattatatattttttgtttttggttaaggagacaagtttgaagagcagacaaaatctcttttttaatatagtatgaatgagaatacttaaaaaaatttaaaaaata

SEQ ID NO: 8212 - DNA, 370 bp, Homo sapiens
ggtacatttttatttttttttggttgatgttgtttgtctttgaatgaagcatgtaatttattctcttaaagaggagaatacatgtggatctttagaaagtaggaggacatgtctaacatagatcgcttgtgtatattttagtctataactgatcatgcattacttagctgggcgtggtggctcatgcatgtattctgaccttctggggcaactgacgctggataatatttaatacctggatagtggatgatgcagtgagccacaatcacgccaatgcactccaacctgcgtgacagaccgagactatgtgtaaacatctacttcaaatatatgggcctggatgaatttaaatccgtggatggcgacgtac

SEQ ID NO: 8213 - DNA, 162 bp, Homo sapiens
tactcttccaattaatatctacattgatattcaccagatattgtgaactgataacactgaaataataagaattgcatagtatttgaagctgcatatcaataacagctttcttggtaatggctcctaatctatcttctttatggtgtggtctgcctcatattc

SEQ ID NO: 8214 - DNA, 178 bp, Homo sapiens
gatagggaaaagttagattattggaagattgtgtatacttattgatgaatatgatattaaaaatggggatgtagataaagaagaattgtgatttgaatgagaatattgagaatggattattgtattgagcttttagtgtttttttatttaataatggaaaataagctgttgtttagag

SEQ ID NO: 8215 - DNA, 498 bp, Homo sapiens
gtaccattttgcagcggagggcatgatggaaggacaagcgtttagaaagtatgtatctactctgtgatcggatattggtatgtaaggagtgctgctgtaactggaaccataagagggattatgcttacacaatgatctcatggatatgtgttgttagcatgagctgtggatgtaggattgtgtgctagaggaacgggtggagagattcttcaagctatggtgaatgatagagataatatatctgtatggcagaatatggacggcagaaagtatttctatatgacaatgattatttgctatgtatagatggtgacattattgcaatgaagctaggacgtgagcacgctaatcactaatgaatacgggattggctgcagcttgaccgtatgagataggtcccaacgtggcggatgcatagattgagtatttgtatgtgttatatagatagctaggtgtaatgatggatataggtgatagtgggtgaatatgttattcgct

SEQ ID NO: 8216 - DNA, 550 bp, Homo sapiens
  misc_feature (1)..(550): n = A, C, T, or G
caacgctctgaacgttccactccacaataggagacaccagctgaagatgcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttangaagattcttccctatcagttaaaaagtttagaagaagaatgtgaatcctctctttgcacatctgcgttaagagccaggaatctagagctgtcccaagacatgaaaaaaatgacagctgtgtttgagaagctgcagacttacatagctcttcttgccttgccaagtacctcgggcgcgaccacgctaatcactagt

SEQ ID NO: 8217 - DNA, 162 bp, Homo sapiens
  misc_feature (1)..(162): n = A, T, C or G
gctgggcacgtaaggtnacgttggtgaatatctctaactcacggcatngtatatgcaggtattttcggtaccaaggacaaggttctaagtcatactattaaaggctaataaaattcaaaaatggtttaaagaattcgaacattttgaatgacgcagagggct

SEQ ID NO: 8218 - DNA, 530 bp, Homo sapiens
  misc_feature (1)..(530): n = A, T, C or G
ggnccgagtcaagcctgcgtatcagaatctgagacagcgtgttgacaactttgttgcaaatcacttggcaactcacacatggagtccgcatctcaataagaaccagctaagaaacaacattagacaacaagtcctcaaatcangaatgttggagtctggtattgaccgaattatttctcangttgtggacccaaagatcaaccacacattcagacctcaggtagagaaagctgtgcatgagtttttggccacgctaaatcacaaangagaangaagtggcaacacagctcccgatgatgagaaaccaggcacttcccttattacacaaagtgttcctactcctgggcccagtgctaatgtagccaatgatgccatgtcgatattggaaaccataacttctcttaaccaagaagccagtgctgctanggcttcaacagaaacatcaaatgccaagaccagtgagagagcgtcaaaaaaacttacatctcatccaaccactgatactaataaccctgccggcggggggtgga

SEQ ID NO: 8219 - DNA, 242 bp, Homo sapiens
gtccggggatgcacgcatgatggctggtggtggtatgttgaaaggataaaccacagccaaatgaaaacactattgatacaggttatggcgacgctgatataagtaaagacagacagcagggcacatgacacgacatacacacagcatggacggcaagcaggaatacagatctgattactgagatgtgccattattgatgtcaagaaggttcacatgatacagtgtatgagtgaaggtctcat

SEQ ID NO: 8220 - DNA, 290 bp, Homo sapiens
acatgatataagagaaatgttcctatggtatatatgaactcctaacactatgatcgtttttttttttttaaatgtgggtattggtgtgttttattttttgctgtttacttcttaactgaagacttgttgcgttgtaaaactgtttaataaaatatatggcattaacttgtatttacaaaaaaataaaagacaggctttacactatttctagggggacactatttcgggaatgttatgtaaaactctctatctagccattgggaccgatatcagttgattgggtatcgtct

SEQ ID NO: 8221 - DNA, 242 bp, Homo sapiens
aacaactccaggtgcaagtgaacaggaataaaaatgccatcgtttttactaatgaatttcacaaacatatataagcgaaataacaatggcagatgcctccactgtacttgagcaagtcatcactgatctgtttggagaaattagtggtgatgtcggtgctggctgtggcctgtttctgtctgattgtgaaataggtaggcctggttatgtactggtgtgtaactccaggtaacggcatattt

SEQ ID NO: 8222 - DNA, 178 bp, Homo sapiens
gttttatgcttgtgggttttttttttctctgatctaggtattaactaccaaataattcaaaacaccaaagaaatcatttgaatgggagaaggagaaacaggttgaagcactgacaatttttgcaagtgagaattcaaggactgtattgtagccacagttatgtacattatctacgaac

SEQ ID NO: 8223 - DNA, 354 bp, Homo sapiens
cactatattggccaggcttggatatatgaaacttgtgtcacttaaaactaaggcggtgtgtgatattaaaagaggtcttttacatctgtgttagctggcttgagaactcgcaactttgactatcttgaatgtgctgctggatggatggcctttgctctgattaggatccccatggtgaaccctgtgcccacagatggatccggatgcagtgcacttgtcgttaatggagctcgtctgaatgcataggagatgtggttcacacaacagtgcaagaaacctacggcctaggtgaggggaatccacttgcgcacagtgtcctctatctcacacccttgctcgacgactgcacagcat

SEQ ID NO: 8224 - DNA, 450 bp, Homo sapiens
  misc_feature (1)..(450): n = A, T, C, or G
gttccagcactgagggaagactcagtctctgccatcacatacacctcatcactaagaagagacacatgaaataattaccatccagtgtgataagtgctctgacagaggatggagtgaggactagtcaccttggggaagacagagaagcaaggtcccaccaagagatgagaagccagcctccangagtgcgctatctgagagggcaagagaaagaaggcaaaggagacgggtccatacttgaacaacttgaaataacttgtctgcatttcaagaacaacctaccacagaccttacctgtcaccttggctctcccacccaatggagatggctctaatggtggcacaaaccanggaagggaaatctgtggtttaaattctttatgcctcatcctctgagtgctgaaaggctgctgtnagctgtatgctgttaatgctaattgggatagggggt

SEQ ID NO: 8225 - DNA, 178 bp, Homo sapiens
aggggtaggaagtgaggtgtatggatatggaaatgtaatgaggtggtaagtaataggaaatttaaaggggaaggtgaaatgagttaggatgtttgtggatgagaagaatgttatagatatttatgatttgtagtgggaagttattgtattgttatattaattttataatagttatggt

SEQ ID NO: 8226 - DNA, 514 bp, Homo sapiens
ggtggcggagcttgaggtaatggtgaaggggtttgtgtgtctttgagagatagagattaatacatctatttataaaatataatcaattagttaatataatattgattaatgttaagtttgttacgtaatttttgtttattatgattttattagaatatatgaaaacttataagattataatgaagaatgaaaagatttaaggttattacatgatgacgggagttgtgatgagtctttttcatggaatggaagatgtattgaaaagtaatattgagagaaaggactgcagagacaagaattaataccaataggaaggcagtgctttgaaattataatgaatgtgagtgaatgagcttaaagtataattgaagagttgttagtgattaaaataattagaaggcgatcgtttgtgatgagatttaatcgaaagtgattattagaaattgaaaatacgtgaagagtggtgtattgagtttgttaaaacgttaagttaacgcattttagttataagcta

SEQ ID NO: 8227 - DNA, 162 bp, Homo sapiens
ggctcgctggacgcgcaggttactatggtgacttaatgtaattctaatgtactacatttataaattttggctatatgaatgtatcatcaatggaaatcgcatatctgtcaaggatctgctctttgctaatgaaaagtggtagagcaatggaacgagcgcttg

SEQ ID NO: 8228 - DNA, 290 bp, Homo sapiens
caggtaccggagttggatccggctgctagctacacggagtgtagggacactcaaggctcttacatgcgggaaccgagcacatcatcatgctgggtactttctggccacatcggagactctgacaattacttgatgctatgatctgactgaagacatgaagtaagaggtcactgtgactaaatatccagaagcctggaaggaggggccgggagctctcaagaatgggggacaagatggccacatgagggcagctctgtgccatatcggcacaaggcggaagaaagaccaag

SEQ ID NO: 8229 - DNA, 178 bp, Homo sapiens
aggtacataaaaacgctgctgggtagaggtcctgtggtgacagagtcaaaagactgcaatgttgatgtcacccggtgaactcctggtttgtgagagtgcatcgggattcaatatcatggaccttaatggagtaattggaagacctcaataaggaaaccattgagcctatggaaggttt

SEQ ID NO: 8230 - DNA, 370 bp, Homo sapiens
acaatatggttcgttcttttatatcgaaaaaagtgtaacttaaaaaaagtttatttatcgtataaaaataagtcttttacatctgttgttagctggtagtgaaaacttgaaagactcagactcagtggtaaacaggatgaatggtcccacctcgcctttccgtttgggagagggatcttgagggctgggacccctctgcgtcacagtaggttgagtgcgttgctggggcagcaggtttctaaaattttggccttcaaggcaaagccatagcaggggatggggtttcagcacaaccagtggcaagaaaagactaggggccctcggctgatgggaaatccaccttgtgcaccagcggttcctcacaactcaa

SEQ ID NO: 8231 - DNA, 178 bp, Homo sapiens
ttctagggtaaaggaaatatcataaaaactaaatataagcagaagctcaagggatctatgtatgaaagtgctgggagaataaaagttatggaagaggaggaaattctgaatcaaacacagattctttggtttctgggcaggattataagtgtgtatagagtgggaagaagctcatatg

SEQ ID NO: 8232 - DNA, 210 bp, Homo sapiens
  misc_feature (1)..(210): n = A, T, C or G
tatggntcagntcttttatatcgcaaaaaggtgtaacttaacaaaaaggttaatttattcgtattaaaaaaaagntctttttacatcctgntgnttaggctgggtggtgtaaaaacttgnaagcaactcagcacctcagatgggtaaacagnatggaatggttccaccctcgtcttttccttttggcagcaggatcgttgnagggctggc

SEQ ID NO: 8233 - DNA, 194 bp, Homo sapiens
  misc_feature (1)..(194): n = A, T, C or G
atactcgggnggnatggnggnctccatccggncctcgcggtccaccttccatcagatgtggtatcancaagacagnagtaggacgagtccggccccctccatcgtccaccgcaaatgcttctaggcggnacgtatgacttaagttgcgtttacacaccttttcttggacaaaaacctaactttgtcgcagnaat

SEQ ID NO: 8234 - DNA, 242 bp, Homo sapiens
  misc_feature (1)..(242): n = A, T, C or G
tcggagtctgntagcgaggtaaaatacgnacccagtaaaattgtcaatagccagtgtcttgtaattgttttggtttcggnttgttttctattagtacttatggtcagtctccggctgtattgcatacctcctgcatgcgtaggtaattacggtatgtgttttagtggagctgggtactttctaggggattttagtcgggggtgtatgtcctttgttgggggctcagctgctcctccctagtt

SEQ ID NO: 8235 - DNA, 242 bp, Homo sapiens
  misc_feature (1)..(242): n = A, T, C or G
ggtacaagagagtcatggaaagtatttgaacttgaacttaatagcgatattattaatgtgtgtgtggcgcacaatcttggcctcaaaaggtcatggataacctgagcatgctcttattacataactggttagacaatacgaccgttcatatacactgcttgctgtatccacggaaagcacacctgtcgcacaatgctctgaaacagctacttcacgttgtgctggacagctgaagangtgtc

SEQ ID NO: 8236 - DNA, 162 bp, Homo sapiens
agtacaattatatggccccagggatattgcggagggatgggtttaaaaaagtctttcggatataagaaagaacataggatgaaatgagtggtggagaaagggttacctatagaagactaattattcaaatacttcctctatctatagtatagtatattcata

SEQ ID NO: 8237 - DNA, 226 bp, Homo sapiens
gtgtacaggctggacacgatgatggatcacaggcgctggatccacgtgtaagccaggacgctcagaacaggcttggcgagggcgtggatgtgctcgcgatgtacgacaagcaccaggactcagagtgcataatcagcgtgcagacacatcgcacagtgcatgcttccggagtggagtaggactgccacatatgggagatcaaagatggcactgaagtaagcgaaca

SEQ ID NO: 8238 - DNA, 194 bp, Homo sapiens
gagtatttggggaacacatgtctaatgaatgccatccttgagtctctcataatcattgatcagtcatgctgttatctcatgcaactgcccgccgaggtagctaagaatgggttaacagcgagcagggcagacataccatgcctggatccaatgggataacaatgtttatttggcagactaattttactaagata

SEQ ID NO: 8239 - DNA, 258 bp, Homo sapiens
gtataaaaaattggagatgtagggggttgtagttgatgtattattatttgattttatattataatattctatttggtgttatataaattgatggggaggtgttttttaaatatttaaatttaggtttggattgattatgtttatttgtgagttgtgattatttttgagttgtgaagttttgtaatatttagtggtggagatggtgttttggtatgtgaatattagcttgtgtgggataaggtggagaatgtggttgta

SEQ ID NO: 8240 - DNA, 290 bp, Homo sapiens
caacctttttttttttttttttttttttttttttggtttttaaggggggggggccacaatggttaaaaaggaccttgggaaacagggaacgaaaaaaatggttttaacaaaatttgggaaccaaagtaaaatgggataatgggggttgggaagaagggaattggtttggtgggagccggctttgggctcccaattccttttttttgtcctttggctggggttagggaaaggggggaggcaaagggcaaagctccacccctgggtattaaaaaacggcagaacaaacatgt

SEQ ID NO: 8241 - DNA, 290 bp, Homo sapiens
  misc_feature (1)..(290): n = A, C, T or G
acatagattatctgggcgtggtggtctgtgtctgtgtaataccagctacttgtnaagtgtaggtgggatgatcaactgatccaaggaggacaaataggtgacaatgagctgtgatattaacactgaaatgcaaccggagctgcatgtgaacctggttgaatatacataaataaagattgctgcaccattggatgaagataggtgatttcatatatgacttgcggccagatgcagtaggaaacatatatctgtgacacgattctacggagatgactggagggagagtacgt

SEQ ID NO: 8242 - DNA, 162 bp, Homo sapiens
tactgtgttgaacttcattattcaatgtcattctatgtcataataacagaaaaccctatacaatcagagttgctcaatactggaccttcatgcaatactaggaaccgttacgctggtgcattgatacacgcacaccatacgagtcacaatgccaaatggaaa

SEQ ID NO: 8243 - DNA, 210 bp, Homo sapiens
gggaccgcagggtgcactacaacctacgaactacgcgcaccaccaactaccaccagctggtcgaacagacgcaagtatcatcacaagcatggtatacaacactgctcctgcgcacgaacacctctggagggacaccatgctgtatgctgctaggctagtctagtatcctgggatattcaatccacttaatctgagttatttagcaagtcc

SEQ ID NO: 8244 - DNA, 242 bp, Homo sapiens
tactcactatcggtgctggaatcagtttcatagaatgactagctaatagctgcaggtggctataaaagaaaggaatgtgcaacaaaggaaatgaatgatgtatatctacatatgataacactgacagcttgtgtaggtaccatggagaacagccgaataggctgatgtgaagatggtctgtgtagggctaaaatgactaagtaatgtgtattgtcaaggtatgttccaatacagtataacag

SEQ ID NO: 8245 - DNA, 178 bp, Homo sapiens
gtacacaggatatagacaataggaaaataatacctcggtcattaacaacacatatagaaggacaccagctgtatcgtgctggctatcacctacctgtatataattacttatctggtataagctgacaacatagaccttaagtgtaggtgggcaatgatgctaggaatctgtggaaggt

SEQ ID NO: 8246 - DNA, 162 bp, Homo sapiens
gtctggacaattcactgagctcgttctctctctctctctctgtgtgtgtgtgtgtgtgtgtgtgtgtgtgtgtgtgtgtatctggctttatgttgcattctttcccattgggccactgttctgtgccaacatgcaacgcaataatctgttacccacattcag

SEQ ID NO: 8247 - DNA, 306 bp, Homo sapiens
tacatgatggaaaggaagaatggacgacgatgcacgacgctgatgaaggcacagataatgacgaggacgaagtggggggacgaacgagggagatggatggtcactagaatagtatgacccctgtggtgggcgaacgagcgagattgacagacatcacagccgcatgcactctgcagtggcaacagatggaggctcaacagcattaaccacgccaagcctcgggcatgtaccagccggaggtgactcaggtgcataagacagcccacagttgaggcgatgacgtgggggaagagcacaagcgagaaa

SEQ ID NO: 8248 - DNA, 600 bp, Homo sapiens
gccggtaccataaagaaagtaggattaaaatctaaaaagacccccaaagcttttcaaaacctgatctgagaattagataagaatatgtcacttagaaagacaagcctgtagcacccatagctctgattaacctgaaagcatcaagtgactccctctttttccaccctaccaacatcactctaattatacttccaattagaaaaataatgtagcatttccctggcagtagagattaaatatgagttcaggaatcagctcctccaaacatgcataaatgaggacaaggagaagccagtcactcctgactgcacggtcaagtgtgtgggcagttgaaattaaggtaaaaacagtgaggctgaacaaaatcacattaagaaaaagcatctcatgaggcttttcgaggtcagttgatgaaggccagataggagtcaatattttctcatataccccagctgttaccactattcatattccaacagcctccagattgctcgaggccacctggttgacttttaccttggagtcggtccagaaaagcattatttacccttgtgatattgtcctcacagtacctcggccgcgaccacgctaatcactagt

SEQ ID NO: 8249 - DNA, 434 bp, Homo sapiens
caggtaccactatttgttggagatattgcacagtggaaaatgacataatcatggatatgctatggtgtacgctgtatatacagttgaaaactatggagttcgaaatgttgggggagaatgtgatatgagaaaaaagatatacatgtggtaagaacctctaacaaggttaatgtgcatgcgcgaaggctcatgaaagatcagtgtgtaaattggcttatagcttatacaaaaaaaaaaagaaataaaaaaaaaaatgacctcggatcgcgaccgcgctaatcactatgtgaattgacggccgcctgcgcgatccaccatatgggcatagctaccaacgcgcaggatgcatagattgagtattctatagtgtaacctggataggttggcgtaaatgtggtcgtatgctgtggctgagagacaattgtatccactcc

SEQ ID NO: 8250 - DNA, 258 bp, Homo sapiens
ggacgagctccagtatatttcgtagataaggcacagatgaaaatgacatagtcatccattgctatgagtgtaagcagtctgtacaatgaaaactatggatgttaaatgatgaggaaaatgccatgcgagaaagagagacatgtgaaactaacagctgacaaaggtaatgtgcatgaccgaggtgatgggagacttcagggtgtatattaccttctacataatagaaaacaaaagaaaggaaaaaaaacaaatacttgg

SEQ ID NO: 8251 - DNA, 434 bp, Homo sapiens
gcaggtgcaagggcatggtgctgagggggcagggggaggctgaggcagccgaaaacgcattatttttctctttgaatgataaagataaatacaactacatatacaatataaacattaggaaactgagacaaagataatggttaaggttataacgtaatcgtaatagcaaaagattataatagaaaaaaagaatacgaagactagtaacatgaggaaggagaaggaaaagagaaaatgaaacatgaccgtggctgaggtgaagatgattcatggagaaggaaatgtatatgaaagaaaattgagagagaggaatacggagacacgaaccaataccaatacaagggcaatggttttgcattaagatgaaggtgacggagacagataaaggctaagtttaaaagtggaagttgatgaaaataatagtaaggggatgt

SEQ ID NO: 8252 - DNA, 162 bp, Homo sapiens
cgtaggtacggccctccccctgtatgcctcttcgtggcagtaagcatggaatattgtaaatggtaggactccagtaattccttccagtggctctactatcaggctaggctcaggtataacccaggttatggcatattcgtaggtagctgctctctatgtctc

SEQ ID NO: 8253 - DNA, 546 bp, Homo sapiens
  misc_feature (1)..(546): n = A, T, C or G
ggcaggtgaaggacctgtttatctctgatttctggagttcagcnactagaaaccatcaatagatgtctcacaaaacatctggaacaactgaagacccctgtggggactctttcagacatctttggaaacctgcatcttgactcattgccagaggagtcagatgtggccactgattctatcccaagagagatcttggtcacaggaacctgccatttgaagtgtgtgtgttacggcattgggaactttgccacctgcatcgtagctagaaaccagctaacgtttttgctgcttttgttggaaaagtgccagattcccagaagtcactgttgggtatatgaccctctgtttagccaacttgaaattgaagtccttaacacccttggtgtgactgttctcagtgagaacgaggaagggaaacggagtattcgcggggagccctaccatcttttacatgctccattgtgggacggccttgtacctcgggcgcgaccacgcctatcactagggaattcccgggggcctggcggtcggaccatttggggagag

SEQ ID NO: 8254 - DNA, 530 bp, Homo sapiens
  misc_feature (1)..(530): n = A, T, C or G
ccngggtgtaacatgccataccatgacccataacaggggccatgcacacccatcagtgaggaccttcggcctagccatgggacttcagtctaactatgtgacgctactcatactaggtatagtaactaacacaatgactatataccaatgaagacacgatgtaacactgaagagcagatgccaaaggcacaagacaacaccagtgcaaaaaggcaccagatgcgggataatgctatcgattacgtgagatgttatttatttcgcaagatgtttctgagtctgttagcactccatgatagtctctacactccaaccaagagggcactggccaactacgagggtaacggcgctcaacacgctagaagccgcactactaaacacatgcgcaacacttgcataaagaggatcaaccagcagagcgaaccatagtcaaatgagaaaaacacgaaaccatacaatacaagcgctgcttaacacaataagaccgggtcattacaataccactgtgcatgcatcatagcctcccgaca

SEQ ID NO: 8255 - DNA, 274 bp, Homo sapiens
cgggcaggtactcaccgtgcgtgacactcaagcctgacttaacacagtgcatgtcatctgatctacaagaagatacagaactggaaatgaaaagacatgtggcggactatcgggcaatggtggaattgcataacgaacctgtctagtgagtctagcgtgatgctccataatgatgcacacttggtgcatcatagaggtgtaagcaggaaccaagaaccagccagcagtgtctacactttgtgattggacacttgggccggggaacacgcctcta

SEQ ID NO: 8256 - DNA, 418 bp, Homo sapiens
agcccccccccccccccaccccggccccccaaaccaccaaatgaagggcacgggaggaggacacacaacacgcccagacacacagcacagcaggggccgcgaaacggagacaaccccccccccacggccccgagaagaaaaacaccacgcccccccccacgaacaccaccaaaaaaaaacaaaccccccacaacaccccccgggacccacagcccaagagaacccaccggagaaccaacaaccggggggaggcggaggcaggccccggggagcagggaggaaagcggacagccaggggaggccgcgacacccccgcccccgccgggaaaggcaggcggcggcaagcagcaacaaggggacagaagggggggcaggagcggccgggagccccccagcaaaaccaaccacaaattccggg

SEQ ID NO: 8257 - DNA, 450 bp, Homo sapiens
ggtaatatgatgaataataaagatgatgcaaacacagaacatacttagtcagacatagatgagtacagatagatgttgaggtggctggggagtcctgagtggggatgttggagaatgggaatacgaaacagcatgctctaataatggacacactgggagagatgcaactaagggttacagactgcaagatgagacaacaatgagccagcgtacacacaaaagatataagaggaacacgctacagaaatcaagcaataagatgaaaaagatagggtacaaaccacacacattaacaaaagtggctacaactgggaggaatggagacaagaggctgtatctgggtgctaaggtgacaagatgcaaggagagggaagtcacatgcaatgatggaaaggacagagagaccacgctgatggtggctatggactgggtaccaccatgatcgtagct

SEQ ID NO: 8258 - DNA, 162 bp, Homo sapiens
ggggacaggatacggaggagaactcaatagcatggtcactggtgtaaattctgcattgtagatacacgaagcagcctttacctattactggagcctgccttcactaacaataaatgaaaaagctgctatgcacttctacagcaggctctgggattgtcatat

SEQ ID NO: 8259 - DNA, 178 bp, Homo sapiens
gtaccattggtggccaattgatttgttggtaagggagggatcgttgaacttatttgatatggaccggtagcgtagggctggggacggggacgaggagcacgatgtaggtagggacgatacatcataccgcttctatttgctgcacgactgaccatgatagtactagccaagtgatggt

SEQ ID NO: 8260 - DNA, 594 bp, Homo sapiens
aggtacacctaagttcacatgaagttgtttcttcccaggtcctaaagagcaagcctaactcaagccattggcacacaggcattagacagaaagctggaagttgaaatggtaagtgaaactgtatccaagtaagcaggtaactgggcaaacttcctacggcacaaatggctttttagttacctcctagtgctgaatgcattaaataaatggcggattcttgtcttgttatgattaataagaaagtttgtaaatgcagcctggatgatgataagcaaatgctgactgaacatgaaggtcttaattagctctaactgactaaaggcatttgttagttttggcaggggatgaacactcatctgtggctattctaagaccactcttatttcttatgtggagtccaacttgcctggaccagcttaatggttctggtaagttttaatgaaaacagtagatagacttaatgaaaatgctgatggtgatatgcttactgctgagctaatggcttaaagcttggctgatgaatactgactgtattttccttgagcatgtgtggaacagcggttatgtgttctccttgaccgtggttgggacggg

SEQ ID NO: 8261 - DNA, 674 bp, Homo sapiens
gtaccttgagaggtgtcgttaactttccttgttaacgaaaacagtatatcacattttcttgctgattaaagttattaattcagagactgaaggggctggacttgctacctgtatagaactgtgtgtaaaggctcttcgcttggagtctacagaaaatactgaagtgaaaatatctatttgcatgaccattttatgtttgttgcctgatgatctggaagtgtaaacgtgcttgtcaactgagtgaatatattattgagtctacagtagatgcgtattatgctgtggaaatgttgtataatcagacagaccagatatatgatgaagagaatcttcctataccaaattctttacgctgtgagctgttacttgtattgaaaactcattggccctttgatctagaattctgggattggaaaatcttgaaacgacaatgtcttgcattaatgggagaagtagcatacattgtgtcttcaataggatgaactaaatgacagtgaggatatgaaaaagtggtagactaccaagaagagagtaaagaaacttctatgaatgggctttctggtggagtggtgctaattttggccttcttaaggacttggtgatgaaaagacaaaaaaagagaaagataaaacaagtaaaaaaaaaagggattaatatgtgcttggattatgtat

SEQ ID NO: 8262 - DNA, 324 bp, Homo sapiens
ggtgaccatgtgagatgtggattaccatgagcaaaacacgacgaatgaggacacctctgaaatatatacaaagcaacatactgatgattgtgataacgtgccgtaaatgtaactgatctctctgtcaccaatgacgacagaggaggcatataacacaaatggcaaataagggtctaggactggaggatccagatgagactgaatgaatgctataaataatcggtggctaccacgcatatgaatagagaatcttcgtgcgattagctggttaacaatattggataaccttcatacgcataggaaggatatgtagtaaattatatt

SEQ ID NO: 8263 - DNA, 194 bp, Homo sapiens
aagcttggtatttagttttttttttttttttgtgggtttagagtggctcaggggggcgttaaggtgtgccagactgtacgcgcatagttcagaaaaaaggggcttgaatttcatgtgcaacttgggatggggggaaagggggacgtttgagaaggagggaaaacagggggggaatatttttcaaatcaaccttc

SEQ ID NO: 8264 - DNA, 194 bp, Homo sapiens
attggggcaatctcaaaagtagtaaaattttttttgtcttttggcttaactctacagtcacagcagaccaagtttcagcttacatttaataggcagaaggggagaaaaaaaattgacaggaatgaaagtgcgtaagaacatcacccttagaaatcaattacaaggtacttacatggaagtagaaaaccatctct

SEQ ID NO: 8265 - DNA, 226 bp, Homo sapiens
ataggccgggcctggaggcgcatgcctgtggtgccacctgcttaggatgctgaggccagataaatgattgagcctgtgaggcggaggatggggatacattgttgattagctagatgagcttgaaaatatagagataaacaagatcctagagtgcatgaagttggcatgagaaatggaatttgtttggtggatgaatctgaaacataatgttagtgacagtaaaaag

SEQ ID NO: 8266 - DNA, 162 bp, Homo sapiens
aatctatgactgcatacagttactaatacaaatattaattacaccacactttggaagtataaaaatggtaaggtaatggtgtgtaattgagaggatgagatgagaggatagtttaggccgtgtcttgctgcttacatgaaagaagacttgtaacaatgaatt

SEQ ID NO: 8267 - DNA, 418 bp, Homo sapiens
tgatcagaacacatcagattagctacagtgttgggattatgggtgtgatctattgctgacggattgtgatattgtttgtgtcattatttggtcactttgatatcgtagattattattgtgttgtgttaatatagtataatatgtgtattcaatcacaaattaaaagacaatatagttgttatcatcaacagggaatgatgaggaaggagtgtaaggagagatcagagactgcaagagaataagtgcagagaagccagcagagataattatatatgtattatataagtatcagtgtatgtcgtggttttcatattgctaggtagattcataaaattgagatctctgtgatactatagggtatatatgttcaacttgatatgaaactgtgatgtgttttccacagcggatgatacggccc

SEQ ID NO: 8268 - DNA, 434 bp, Homo sapiens
cgggtatattcatagttaagtgataggtacaattaaaaattcatggcatgtgattaaatatctatcgacacatgctctgtttattatgtaattctgatatcttgaactaggatgtggatgtggattgtggtctgataggtatctattggatactactaccaggttgagttgttcatgattgacatggaaaactaccaattgttataacatataataatcatctatacttacatatgggatggttcattagggtcgacaggtgtgtgcagtgtcccatgttagtaatctgacttaatgtgaaatttatgacccccccttggtgctcctatgtggttagtggatctattatattttctttctgtttggcttttctcttttttctgtgttataaccgttgtgcggtctggagaatagtgactattttgtgtctgttt

SEQ ID NO: 8269 - DNA, 306 bp, Homo sapiens
ggtctaattctctcttttggaatgtagattttttttttaccatgctttacgatgtaaaatatttatgttttattgattcctggatatctggctgagggattatacatggaacaggaagatgcgtggtgactattcttgtcggtgatgttgagagtctctcgtgactgtcatattgtagtggtagatcatatattcactctggtaggccgtgacttttaggcttagttcagactgtgtgggcggcgctctagatgacttgtgtctgcgcgtctgtctggaggacagcactatgggatagatcctaat

SEQ ID NO: 8270 - DNA, 290 bp, Homo sapiens
tgtatattctagaagctgataattccagttctggcgaactaggaagattagagcaagattctcaatcagcgtatgatcttcggagaggtgtgggaatgtgttatataacattcatctttcggtgtgctcttggactaatcaacttatcttccataagatgtggttatgggttctgtattagtggtggaggtgggatgagacgcacttaatcatgatgaggattaatttagatattgggtgtgatagtgtcttgagaattgttaagcactattatgtaatagctatttgat

SEQ ID NO: 8271 - DNA, 178 bp, Homo sapiens
gaggctgtcaatggtgttagagaaatgagggctccctaaaacaatttctttatgtatatgttagtcaaaagttatcatgctgtgactatagttatagcgatgaagatgaagaaaaggcagatgctttgatcagtttactcatacaggaagggatagacataagtgacctcttcatgcc

SEQ ID NO: 8272 - DNA, 194 bp, Homo sapiens
cggagggataagaaggtaagtaagataatgtaaaataaaaataagtgatcaaaaaacatgtaaaaaaacaaatatatttagagaacataagttatgttcttgttgtggtggtggaggtggggagttggtgaggtggtttcatcgtcaaacgaaacagcacgaaataataaagaagaaaatacaccaaaaaacaa

SEQ ID NO: 8273 - DNA, 258 bp, Homo sapiens
ttgatcgagaagatgagaatgtggcttgtgatttacaaagaatattaggcttatagtctcagtaacataatgatcatttgaaaggtatatgaatgtgttggataacagtttacatttgagtgtgcttctctataacatgattgatctaccctaatattatgattatgtatataaggattgggacatgtggatcaggtgtccggtattgatggtgacgatgatatgtgattatgggtgtgagagtgaatattgaaatgg

SEQ ID NO: 8274 - DNA, 498 bp, Homo sapiens
aggtactaggaaaaggcctggctgccatccatcgctgcctctgagggtggagaaggaggcgggtgatgtgctcacttctgatcaacatgtgttgcctcctctcagccaacttctagctcactgcactcactctggtcatgataaatgttcgtcacctttctgcttcattccttagggcctaaatcaggaagctgttttatcgatggtttccttttgggtcagtaaccagctttggataatttcctctgattattcaagtcgtgggacaggtaaactacattcagcaggaacttttctcgaggagtgttatgtcatggaaaagacaccaaacacagcaagtattttaatgaatacaccatcccaggggggtcagtaagctctgcctggcaagaagacacagtgagaggggtccacagttcctgatgagggtgggtgtgggtacttgtagaccctaacatgggcaggtctgggtcacctttagaaactctcagagaaact

SEQ ID NO: 8275 - DNA, 258 bp, Homo sapiens
ggtacatataatacagtctgtcaagagaactactggttaaccaggaaaacttggcatgattctcagcgatattgtgttctactgaaaggtacaggaatgcatcagataaaatataaagtgtgatgtgctcttgcgacagcgtcacgcatgtgccctaagatttagttgcttggatccgaaaagagggcggtgtggcattaggctcctgtaggcagtatgaggatgatatcaaatcatgggtgtgaaccttggctgctg

SEQ ID NO: 8276 - DNA, 242 bp, Homo sapiens
gccgccccgcggccagggtacaatgacacctttggggaaggaaaagaaagactaccgttctcaccccctgaccatttggtattagcctggctgccctcaaaaacttcccacgctcccctcccctgcgccaccctcctaaagatgacctggatactacggtgcctgcccccaccccagttagcctccccctactccctgggcctacggagcgcgcacagggcgcatgtacctcctaagaaatt

SEQ ID NO: 8277 - DNA, 162 bp, Homo sapiens
  misc_feature (1)..(162): n = A, T, C or G
tatattaatatntgaatgtcgttgtgattcttatggtactgtgatatatgctatagaaagatggattggagggtttgaataggttatggtatagtcaggagagatagaaatggtgtatgggaaatggtcgtggtatgatatgatatgttattctgatcttca

SEQ ID NO: 8278 - DNA, 402 bp, Homo sapiens
  misc_feature (1)..(402): n = A, T, C or G
atcatgaaatatactctatccctcttctgcttaatatagatctgatctcatactgacttagaatacaatgatatatgtagtgtgtgagtcgtgcagtggcaaggtcaggaatgatagtgatataggatatagtcttgtcgtggtgacgggatattgagtttctattatctaacttagtgtcacaatcttgaagaagtgaatagtttgaatcagaccagttatcattcttgatggaggaaaagggatgatganggtgggtgaacagcatctcctttgctgcctctctgcctccactatcctgtccccatgaggagcggaagaaccgttatgactgatgagtggttcactgcatccctttctcctggcgtggtcttggctctagctgcactctttaggggcaga

SEQ ID NO: 8279 - DNA, 274 bp, Homo sapiens
tgtattgaagtaccaaatctattgatgtttggtgctgataaagaatgtagactgtagagactagcagtaattacttgttctacttaatgatgtcctatgttttattctacatgcaaaaagaatgattgatcttcgagcattgttaaatgttgtgggcggtaattattgtggacagatgattcttgattttgagtctatacagatgtgcattattgctgtggaaaggcacgaggcagctgtgtagctcttataaataaggatcaaatattagctt

SEQ ID NO: 8280 - DNA, 194 bp, Homo sapiens
gtgatgaagttaaaattattgagtgggtgcagaataagagtgtatacagtagagaatagaagtaataatatggtctacttaatgatgtcctatgtaatattcgacaggcaaaaagaatgattgatcaccgagggatgataaatgttgtgggcggtaattatagtggacatatgattcttgaattagagttatgg

SEQ ID NO: 8281 - DNA, 178 bp, Homo sapiens
tttggatgtaggacaactcatttgagaatggtatgatgaatggattgaatctactgggtgataaatatgcatacaagtgaccagctacttggcgtcaattcaaaatactattgataatataacaaatcccaagatggcatggtacagaaaagtggatgatgtgcatacttaatgttca

SEQ ID NO: 8282 - DNA, 162 bp, Homo sapiens
cacagcagagggcaagcggacacgacgaagagacaaaagacacaaaacaagaaacacgaaaccaaaaacaacggccaaacgcaacacaacacaccaacacaacaacacacacacacacaaaaacaacacaacgcaacaaacaaacaaacacaggacacaggc

SEQ ID NO: 8283 - DNA, 242 bp, Homo sapiens
gcaacacgagccccatacacacagcaccggggcaaagcgcagagccggacgggcaccgggcgaccccgcgccccgccgcagcaaaaacaaccaaacacgggcaaaaggagaccctaacaagccgagaagcaaaacgtcatcacacgccaccccctgcgcaaacccgccgggaggagcacaacaagaagcacccagacgccccagccaaccccccagagccccgtaacaaacgcccagagagg

SEQ ID NO: 8284 - DNA, 530 bp, Homo sapiens
  misc_feature (1)..(530): n = A, C, T or G
gggcaggtacaagtgtgcagagctgggccttcattccacaggacataatgcatggacaatataatgttctacagaaagatcatgccaagaccagtgatccangaagatcatggaaaataatgcacatcagtgnaacaagagaacccatagagcttaaatgtgtgtctgtgacaggattcactgcactgtttacttgggaagtggaaaggatgggctataccattaccctctgggatttggagacccagggcatgcagtgttcttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattgccatacatgcactataggccgggatagaaaatcgtcagctggacacaggaaatttctttttggagagcaag

SEQ ID NO: 8285 - DNA, 306 bp, Homo sapiens
acaccaaaaagtaaacatgcaaagagggccgaacaacagtcataatgataaggtctgagaacaaaatcaggagaggatagtgctaaatggctgacaggatattagccatacgacattaactacatctggtgaggaggctacatgactggagaggcagcaaacaactggaagccaaagaacacctcaatgcatgactcagaggggatagcagcagaatatactgcaccctcggatccgaactaacatcaaggatataggcctaaagaggatggagcttctaagatgttatgaactggtacgagagca

SEQ ID NO: 8286 - DNA, 194 bp, Homo sapiens
tgagaaggcgccgggcccgggactaggcgtgagccggggagggtacactggggcgcagctctgcggcactcgtctggtggtaataaataaactaaaccatgggtcacaaggtacgatccctaatgaagctccgagtaggacaaaaatgctcgatgatgatgtcacttccttctgttgccagaactttgcgtcgt

SEQ ID NO: 8287 - DNA, 178 bp, Homo sapiens
cagttgcagtagtataaatccgaccgtgcctggcccagcaggacccccaggtggacctgttgaccaaaacaccagcatctggggccgtgtagtacaggtaccctgtctgaacgatagttccaaaaaactgcaagtaagtatggtgggatatagaccccaccccactaacacagtgttt

SEQ ID NO: 8288 - DNA, 194 bp, Homo sapiens
tgtggtggctgtataggcaagttctagcagccttcttttccgacaggtccctttccaataccaaccgctggttgctcacctgcattaaccacccccacgtgcggtctgtcttgggggaagtggaaatgggtggagatgatggcctgagtgttggatggtgagaaaaggtttgtcgaggaggacgcgtaggcgta

SEQ ID NO: 8289 - DNA, 210 bp, Homo sapiens
agcttttgttttttttttttttttttttgggaagggatgatgtgattttttcttttataacatgatttttaaagacattatgcatgggggtaacattcccttgaaagggggcttgcaagggttatgagcctctagccgagctggaatctggaggaagaggcagagaagcttggggaaaaagaggcaggggaggagggggggggcataagg

SEQ ID NO: 8290 - DNA, 162 bp, Homo sapiens
tgggtgataagggtagatgtattattattgtttttgattttgatgttgtgttttttaatgatttgattatagggaaatattatgtaaaataagtgtggataacaagtattgaatagggaaggggatggggattgtgggggagagagtgagttgatagtgagt

SEQ ID NO: 8291 - DNA, 162 bp, Homo sapiens
gttgtgagggttgggtggtgttatttgtaaaaggggtgaaggtgaatttagaatggacttatttgttgttgtgtttaggaggttaaaataatataaatgaaagagtggaagaatagtaaaagtaagggggaaggagggataagggattgtggtttggtttgt

SEQ ID NO: 8292 - DNA, 514 bp, Homo sapiens
accgtttttttttttctagagtcagtaaatataagcttgagttgaaagactttacttattcctgctgctacaatttaattctctaataataatattatattcagagtatggcttattaagtacagggcccacatattgaaccaagttcatgcagatttggattgaagttaatactaacccaattacaggttgactataacttgactcttaaatttgatattatcttcaaaattataaatagattacagagatttagaactggttataatttagtaagattaactttgcagtgttagaatttttagcaacaaatttttagaatttttttagcaaaaagaggaaatacacattaacaataaaatatgctagactggctctgttggctgaacagagcatcatgtggttaaagaactgtagaaacgggcttaccaagggttgaattctacccactgctctccggtgatgtagctgtgttatcctctctgctgtattctcgggttctcttagggtcatt

SEQ ID NO: 8293 - DNA, 210 bp, Homo sapiens
gggagcgcagggagctgacgtctttccgttacaaccctgagttctactctggcattggggactgtgaggtacacatactcaggtccagggatggaggggtggtcagggacgctataggtgaccttctggttgtatatacgggtgtgtgcttaacagccaaagtttacctgagtccgttttcttggggtgatgaacagatgctgtcttgcc

SEQ ID NO: 8294 - DNA, 242 bp, Homo sapiens
tctggagtcggcaggatagcgggaacagccactgggctttggggaaaggactcgattagtagatcgagagtattcgtttctatgcattatcaccagcgcggcatgcatatgttctaggggcagatcattttatatatctgagttatttaggttgattcattgcaggggtctagttacatggaatgagggtagacatgagttctgtaattacatgagagtaggtaatggggctttcttcagag

SEQ ID NO: 8295 - DNA, 258 bp, Homo sapiens
gagtgagcatacattaggatagggatggatgctagtctaagtattgtcgatgtgcttactactacctcctgtgatcgtaaaggtgattgatatataggagtggtcttgctatgtacgtgtatgagacagagtggatggtgaggttaagaagatggacctgttgcgcgccgttttgcacatggtatagatagatggtgatgagtgcagaataatctgatgcttatgtgaatgagtacgagctggatttgtacagccggt

SEQ ID NO: 8296 - DNA, 354 bp, Homo sapiens
ggcgcaaggcagcactggtggtgccggcattcgagaccctgcgctaccgtttcagcttcccacaattgaaggtggagctgttggcgttgctggatgctggcactctctacaccttcaggtaccacgagtggtcccgaggcctcgcatcttacagactatgcccgctggcgggaggctcaggtcccgtaccgtgtgcaatgggcggcccgctatgaactctacgtggtggtgccacgagactgtccccgctatgatcctcgctttgtgggcttcggctggaacaaagtggcccacattgtggagctggatgcccaaagaatatgagctcgtggtgctgcccgagggcctccgcat

SEQ ID NO: 8297 - DNA, 162 bp, Homo sapiens
  misc_feature (1)..(162): n = A, T, C or G
aaaanaagtaccacctgagtcagtgagggccacagattggtattaatgagatacgaaggttgttggtgggtgggtgtgtgctggagctaagtggataagaatgtagtgggagtggaggtaagaatgggtgggggtaaaggaagggggatgggagggcggggg

SEQ ID NO: 8298 - DNA, 354 bp, Homo sapiens
tcaaatgtagagtagagagggaagggaaggagaaggtgggaagtgaaaaaagaagatgaaaggaggatatagagcagaaaaaagaaaagatgagtatttgtgaaaggggaggaaaaaaagaaaaaaagattgaaaaggaagaggatttattgtatagaagtaattgaatgaggaaaatggtgtgtttgtttgatttagatttgtatattttagtaaattatagttggggttagagaatttgtatgatataggatgaacaaaaaagggttagagagagttatatgtcataattctgaatttaattgtggtgtggagatgttaattaattatataaaggagaaaataagttgttaa

SEQ ID NO: 8299 - DNA, 194 bp, Homo sapiens
tcagtgtatgacccgtgaggtgcctgagcgtatttgacgcgtttctgatgattctgcgggaacagtggtgcatgtgccgctagaccggcgagctcggcgacttgagtgatgacgacttggacgtggtgtccaacgacaaagagaagtgtaagacgttagccggacacgtctgagccaggagggaggtggggttg

SEQ ID NO: 8300 - DNA, 226 bp, Homo sapiens
tctggttactatgtgacctcagggagaagttagtaagatattgtgcatacacgttattagatgggcgtacaagtgcatacaagtgataaaagaagggtgagaagagatgtctgaatccagaatcgaaggcgatcaagaattactgaaagcagttgagcgaggagaggtaggtttgatgtagccggcagaagaatcgctatttaggaaacggcaaactgggagtcgg

SEQ ID NO: 8301 - DNA, 533 bp, Homo sapiens
  misc_feature (1)..(533): n = A, T, C or G
tacactacaccagccgccagctctgccccacagacaagaccatggagtttggccgagacttccggatcaagcactatgcaggggacgtcacgtactccgtggaaggcttcatcgacaagaacagagatttcctcttccaggacttcaagcggctgctgtacaacagcacggaccccactctacgggccatgtggccggacgggcagcaggacatcacagaggtgaccaagcgccccctgacggctggcacactcttcaagaactccatggtggccctggtggagaaccttgcctccaangagcccttctacgtccgctgcatcaagcccaatgaggacaaggtagctgggaagctggatgagaaccactgtcgccaccaggtcgcatacctggggctgctggagaatgtgagggtccgcagggctggcttcgcttcccgccagccctactctcgattcctgctcaggtacaagatgacctgtgaatacacatggcccaaccacctgctgggcttcgacaaggcaggcgtgagc

SEQ ID NO: 8302 - DNA, 594 bp, Homo sapiens
tcaggtgggcgtcccctcttcccttgcccttctctgcacggtaactccgtccctcggcatttctcaataccccttgcccctagatccaagcctgtctcttgaggaacaaccgcgcagaccctgcctcttctgaccacacgacccgccttcagccacttggtctggtctcagacccctcagagcaggaagtgaatgaattgtgtcagtcggtgcaggagcatgtggagctgctgggctgtggggctgggccccagggtgaagccgctgtgcgccaggccgaggatgccatccaaaatgccaacttctctctcagcattctccccattctatatgaagctggaagctccccaagccatcactggcagcttgggcagaagctggaggggcttctgagacaggtgggcgaggtctggcgccaggacatccaggacttcactcagggcaaactggacacagcaaggagcctctggccacagatgctgcagggattcaggtggagggaggagatagagggggtctggcagggtgggaggggctcccggagctggtcccagagcaggggtgggagatgccttgtgttagctcagggagatg

SEQ ID NO: 8303 - DNA, 178 bp, Homo sapiens
aggaggaaggtggtcggtgtgtagcaagatagtagagagaactatgtcctgatcctctgataggaaatgtgaagacgggatgttttgatgggtcccagggagctactgcttggtacaggccccaggaggagggccaaactctggacctcatttctgcagtgactaatctggatgtacg

SEQ ID NO: 8304 - DNA, 178 bp, Homo sapiens
gggtgacatgtcagatctttgtacgtaattaaaaatattgtggcaggaaaaaaaaaaaaaaaaaaaaaaaaaaaaaaaaaaaaaaaaaaaaaaaaaaaaaagaaaaagaaaaataagtaagggggccggagggttattccctttagggagggtgaatgtttagtttggaggtgggcgg

SEQ ID NO: 8305 - DNA, 642 bp, Homo sapiens
agtttcttctaaggcatcaagagccccaggctgaaaagcaccccagagctggagcttatagaacccagggcagcaggttctccaaccttctgacatcatcagagcacagcagacaagttatcagccactagatttttttccccctttctgaaactgtaacctttcattccagccattccccagagctggacagaggacgtggctggctggctggtttctgtagtcagaatgacagttgggtgatagatctccttcgtgaagcaatgtcttagctcagtaactctgcagagaagctggctggttcaggatgtggcttatgtaagaagatggccctggcgttttacgcgcactggtgggtgaggctctgaaagtggtagaagggaattctttcctagagttcagctgcccgctgtcctgctcctcaggggaaatgctgtgagatctgcatttagcctgtgtgtgctgattgtggttctgccgcttcctggctgtgtgagctcagacaagtcacccaccccctctggggcagtttcctcatctggagaaggggagagtgccccacacattgggctggttgtgtccatggagtggctgacaataaccagcacacacgagacatcagtagcaggtgggttcttcccc

SEQ ID NO: 8306 - DNA, 546 bp, Homo sapiens
cgttcttctaaggcatcaagagccccgaggctgaaaagcacgccagaggtggagcttatagaaccgagggcagcaggttctccaaccttctgacatcatcagagcacagcagacaagttatcagccactagatttttttccccctttctgaaactgtaacctttcattccagccattccccagagctggacagaggacgtggctggctggctggtttctgtagtcagaatgacagttgggtgatagatccccttcgtgaagcaatgtcttagctcagtaactctgcagagaagctgcgtggttcaggatgtggcttaagtaagaagatgggcctggcgttttacgcgcactggtgggtgaggctctgaaagtggtagaagggaattcttttctatagttcagctggccgctgtcctgcgcctcagggcaaatgctgtgagatctgttttttagctgtctgtgctgattgtggtgctgccccttcctggctgtgtgtactccgacaagtcaccccacccctctggggcgggtttcctcatctggaag

SEQ ID NO: 8307 - DNA, 370 bp, Homo sapiens
atgctcgattgtgtaccatgtactggagaaaaagcatcaagttcttaaaccatgtagcttcgtaccttagtacgcatcctctatctgtggaggctcaaccaattattagccagcagacagtatatgcattgaaaatggcctaatgtcatataactgatgggggtggaaacaggatggccgaggaagctgtgagggtggatagagctggcttatcattctgtgctgtcttcatctgtccataccgcttccaggttgcatcactctcacagcgtgtgagtgacagtatcaggatggttgccggagtctcatgcgttgtgtttatgtataaagggtgcagagagattcactgaaacagatactaaaggataac

SEQ ID NO: 8308 - DNA, 450 bp, Homo sapiens
gagtgagactccggtggcaggaacaaaaacaaagaaaaacgacaccaaaaaatataaaaacacatcagcttgacattttggaggcattcccagactcagggttagtcagcagattagcatttaagaagaaagtcttgtccctacagattgcctgacctcagctacccatgaagggtgggaagaggagtgctgaggaagaagtacaggaaggggacaacctcctcagacctgataggacactcctgtctccaccctgcctcctgactgatttactctcgggggtgtgaggacctctgagataggcgccaggagtctcacgcgcggcactgatgtctcaagggtgacccgagagtcgctgaaacagatactagaggaggggcaggtgataggataaagtgagaggtactgagacttgctggcgtgggtgagcggctccgggggggccgaacg

SEQ ID NO: 8309 - DNA, 642 bp, Homo sapiens
gccgccactggtcgaactccattgtcggggggcctctaccagccgcccctggcgaagtccattgtcggggggcctctaccagccggccgtggcgaactccattgtcggggggcctctaccagccgccgctggcgaactccattgtcggggggcctctaccagccgcccctggcgaactccattgtcggggggcctctaccagccgcccctggcgaactccattgtcggggggcctctacgagccgcccctggcgaactccattagtggggggcctctacgagccgccccggtgaactccattgtcggggggcctctataaggcggcccggtgaactccattgtcggagggcctctataatgcacccctggcaaactccagggctcgactcaggtcggatcgagcccgctctggggtttcactgaaatcgtcagcattttcagagacagcaggagccctggatgaaaggaagactggcacccttgtgtgggaaggaccctcccccgattttggaacagaggaggcagagctcctcctgaaaggtggcacctgccccggggctctcctggttaccccggagcaggatgaggccaggaggtgagcgatgaggccaaggttgttaggaaaggaggggcagctgggt

SEQ ID NO: 8310 - DNA, 370 bp, Homo sapiens
gaggcccgacctgggaaggctggcgaacgctaaccggagggtttttcttccagacttgattccgggatgttgagatcgttattcgaaatagactagcattcgagtcgcctgtgatggagggagttcctgcaccgtaggcctggcctcatttattctgcaaatgtttattgggtccttgccctttacaagatcctgtgctgtgagcaggatcagggctttcatgtggaaataagtcggcctttggttgaccaactgaaactcctctgaatggaaaatcaagaaatttttggaaaacttagtaaaatgttcaatgagttgcatataagtattccttgtttaggtagcctggactttgtgaacttgagattct

SEQ ID NO: 8311 - DNA, 434 bp, Homo sapiens
ccagagcgagactccggtcttaaaaacaacagcaacaacaaaaaagatttgatgcctctgatggagctgaacatttattatacagcaacagcagcaaggattgctggtgggcagactacactgtagggcatctggtcttctgttagagtctgaaggacactattgtcagagctctgcccttttggaatgaagaaataattcccagatccaggaggggaaacaggtgttggttgagggtcctggcagcagcttttctggcacagtcgagacttgggaggctctcccggaagggggcatcatggagctgagcctgcccactgggtattccattgtctatgaattgaacaggaggagcttgaagcccattgagctcatgcaggtaccaggagacgaagagggtgtgcataaagacatggaaggggtggtggttaggg

SEQ ID NO: 8312 - DNA, 482 bp, Homo sapiens
cacgtttcacagatgtggcaactgaggctcagtgaggtgacctgccaacatcctcaggctcagcagttctcaagcactactgcccactgtacctgattgcctgggtctgcgcctgggcccccgcccttttacaaaagggtcacggcctctcaagagctggacatgaaggatggggcaagtccagtcttgatcggtaatgcccacttgacactcccaggagcagcatcatagcatttatacaactccttgtctcattcccgatgctgggcacacaggccatatcagtggactcccctcacccgtccattcagttacaccacttaagcctgcccatgaagacaatggctaaggtgacagttggttacataaattgaagatgagtctctcctccagatgcatggtccgtgaagaaatttaatagcaaagacgagaagaagatacaagtctttaatagttctctgggtattttctcacccaaacag

SEQ ID NO: 8313 - DNA, 466 bp, Homo sapiens
gacatgccccaggggacatcagaggtctctctgcatggggattaacaggagaggaggaagccctgacatgtccaataaactcaatcatctggaagatagctcagtaggtgtatccttgacccagcattgtgggagaagatatgtctggaatgtgtatatctgcggggagtgagaaaggaatgtcagcagtcaggatgtctgcagatggggaattagaaatctgtcttagtgttggtgggagccagttcaaaagagacttcagaaggattgatggtttagacggggtatctatataggacctgtttagattaacttcagtggaatgagggatgatgtattaggataatatagttagctgtaaccagcaactgagctgtaacaaagccactgacacttctcactcatattctatagtccagtgagggtctaggggacagggggtgctctgctccctccattctttctg

SEQ ID NO: 8314 - DNA, 322 bp, Homo sapiens
acagtccggtaccagatcgccccatctgccatcaagaatcaataccacacactccatccacaccactcccagccctgagaggggctctggccagctctgctaggtctgagctgtgtctatgcccggatgtggcagataaggagaaccatggtaggagccgtaagcagctgtgcgcaggcagccagagggtctcgagggaggaaggcgagcgggcgggcggagcctggcggcgggccacagcttcaagagcccaagccagcggtgcggctatccgggggatccatatagagagggaggtgcggcgcacggccatctagagggg

SEQ ID NO: 8315 - DNA, 562 bp, Homo sapiens
gctgcagccaagattctgggggctggggtggcgggtggaggtggggttggagggagcgggaggaagcagccagaactaccaggcggcattgcccagcttcttctgcttggccgcctcccccgccagccggccggctatttttggcatcttggcagctgagcccccctcggcatccccccaggccccgtggcccaaaccaggttgtgcgtctcctcacggttcccactggccttcgatcctcatttgctaaatatctgcgaaggcagctcccgcctccccagtgcctacgcgaatttaatcccagagcgaacagacgcggagccccgggagactgcttcatgtcagagatgaattgtacgtaagtgaggacagggtttgtatcttgcagctgtaattcattaagatgaggtcacgcaggagcagggagaagcctaattcaatgactggcatccttataagaaggaaatctggacacagagacacagggcacgggcaagtcacaacacaagcagagactggagtgattcatccacaagtcaagtgacaccagggatgggcagct

SEQ ID NO: 8316 - DNA, 418 bp, Homo sapiens
  misc_feature (1)..(418): n = A, T, C or G
tgctgatctgactgtctttttagtggtcacactatccttaccttctgtgcttaccattctcttgtttactaatatgatatagtacatttctcatgtctctctaagaaagattgttaatgtatggctggttctgcttcatcttaaagtatttatactgtatgtggtcttctgctaatctactgatatctgtggtatgattattagaatcatatatatttgtgcttgtggttgaatgtagtattctatcatttggtcatagtctcataattgctacattgagctctgcatggacatttggatgctttcttattttatgctagtagtatgtgtgtgaggacagattagtgatcgagaatcactggaatgtggtggtgagatatatatatnttctccatatctaagtaagggattatatttc

SEQ ID NO: 8317 - DNA, 242 bp, Homo sapiens
accttctgtgtaagagtcagtgagagtagtagattgagatgtgagaaatagtagagaattagatataatggagaagttggggtggggtgctctttgaggactagctgctgttcgtgtgccttgtgatgccttcagggtgctgcttttgtctgctgtcgggtggatgtttagggtgaccagtggctggatcatgtgcggtgcatgtatacttgtatttgatcgcaggtagttatagaattatt

SEQ ID NO: 8318 - DNA, 258 bp, Homo sapiens
ggcgaatgcgagtgaacctcgactggtcttcgattctactaggttgtcactatgaccaataaccacccataagaacctcattgtttactatttggattgctgtgtatatacaagacagatatctccctttatggaaggagtaatatgatgaatcggtatgggatgggttgcggtgtcttggtcgtgatcaagctagttactattgaattgggggccgcgtgcatgtcgatcatatgggcagaaagtcctagcgtggtt

SEQ ID NO: 8319 - DNA, 546 bp, Homo sapiens
ggtactgaacagggaaagcatacctcaccacagcgattagcatagtgcttccatgcgtgatgtgacgccatctacttacaaggggtggcatttatatcagtaacaggatcactggtgtcatcatgagtagggtgatatacatcaatacccaggaccaagcatgatcatcctgctaatactgtcatgatgtgggtggggatgttccagacaggaaccagaggacaggagcgcagtaccatgacaagcaagatgaccagatccttcacagacataggggaaattataatgactctgcctttggactataggtataaataatggaatggtgaaggcttatggacatgtgtgtctaaggtgacatgtaagcgaatgatgagaggtgacttgaggcacgggctccaaagaatctcacgatgtaagctgtccggccataagtgcttgagacagaacagataggacgagtaaccaatcggaggggcgcaactcactatacaactattctatccactgtggaacgcatgattgtgtggatggtacagatacggc

SEQ ID NO: 8320 - DNA, 274 bp, Homo sapiens
gtactatctgtgaagttacacttttttttttttttaaaggtagagatgtgtgtgtgtgtaggtattaaagatgtgttgttggttactaaaatggattagtgggagatgagttatgaatgtagatgtattcagaagtagggtgacagattttttggtgacatggcgtggtggggtggaaatacagtggagtctgaaggttcggggagcgaagaatggcaatatcatcgcacatccgtgctccacacagcgctagtgacagatggagacctcatag

SEQ ID NO: 8321 - DNA, 290 bp, Homo sapiens
gccgaggtacatgcctgtatacggacatcctcttatttaagtgtttgtctctttcgtcattggggactccagcacccaaacatagttccctagtatactagttggtgccgaataaaaagtagctattattagaaaaggaaggtgaaattgacatgggagttagtaaaatgtataaggaaaatgatttttataggggaaaggtaaaggattttctggccggaaaaagcagcaaaggacaagtattacttaaagtcttgtgaaaataacacttcttcttgcttgtacctggc

SEQ ID NO: 8322 - DNA, 242 bp, Homo sapiens
gcccgggcagggtacaagcttttttttttgtttttttttttttttttttttgggttcaagataaaaacaaagtacaaaaggaaaatggggtgctgctactaatgcatcatacaaaccaatagcactgccgacaccgccaactcaagccattccaaccaaaggaagaaaggctggcgtttgcaccccctgagggaagggctggcttgtaaaacagcacaattcggagtggaatgggaagggta

SEQ ID NO: 8323 - DNA, 226 bp, Homo sapiens
ccgcgtcggggcagggtggcttaacgaaaactggaaatgtctgttgatggggaagaaacaagagctaatacaatagctaggagcaaataatatttctcttatatagcttgaaggtagcaggtacagtagctaggtacatagtgaaagaaggattacgatggtaatgaaataatttgtttgatacgctaatggctataggggatattgtgtaatatttgtaagtttg

SEQ ID NO: 8324 - DNA, 290 bp, Homo sapiens
acaagcttttttttttttttttttttttttttttttttttttttaaagcattaattaattaccacactttagaaagtatgttcgccggtaatatggaacgtagggggcaataaataataaaaggaggcgggaaaaaaaagacagatacggggaacatagggggccccgcggctccaggggcctcgaaaggtctatcgcgggaccccaccccccaagaagaaaaaaaccccaaaagccaggggaaacccccccgggggggggtaaaaaggggggaagggcccggggctccc

SEQ ID NO: 8325 - DNA, 226 bp, Homo sapiens
agtcttatttagcaccccagccatgtagacttctcatgctggcccttcttggcatctgctcttctcactgtcatacattgtgggaaggtgtaggggagtgtaagttctcagtataagtaagaaccctgtgtgagaccctccactacccagcgcactggccggtttaggaggaaatcaagtacactacaccaatcacggaaaggtctccttgcagagccagttaatt

SEQ ID NO: 8326 - DNA, 194 bp, Homo sapiens
cgggccaggtacccttatggaccctggcacaaaaatgattcagcttcagcgccttttgcctgcagttgcaggctttatgaagcaggttctccacctccagtaaattaaagtttttaaacaagtacccagggagaacggggaccctgcaccctggattactgggactggcacagtgggaggaaggggggaccgtg

SEQ ID NO: 8327 - DNA, 306 bp, Homo sapiens
ataagctagactccaatattccacacagctgactgatacgtggatgcaataacatgtgcatttcttaatactacaacttcatggacagagtagggtggtgagatgaatttgactgtgtctaaatcagtgtcctaaatggctggttctgtctgtgctcctttgacagagagcaagacagacggtaagtaggagattgactataatggggagatgatcgactgtgtgtgagagggggaaggggtagagagaggagggaatattggtctcagaggtctcaccatcttaatttggttgctcctaatgata

SEQ ID NO: 8328 - DNA, 530 bp, Homo sapiens
tacatgaagtctgtcttttgtcaaagttctatgcagtcccaggatagcgtgatagcagtggttaaacacaaccagctagttatagctttcattgtatggaaagacctctctggtctggaactctgcctttgaaattatccacgtagttcagaaggcaaatacttgttaaagggatcccaaaaggtaggagacaagtagtttttgttatgcattagggcagactttcaagcacaagacacaaaattgagcagcaaatgtttgggtagtcccatctcccttcggtttatatgtgggtagtaaaataaataaaaattttcttctttgtctctttcttgaaataaaatatcatgtatccaaagagagctgaggattctcaatttgctagattgctttaaaggggtcagatttataaaaataaagaattaatgaagaacaattttactggagttagtgtggtcaataggcccttttcattttgtgtcattgcttttatcacaaagatgttcaaatatcaaataaaatgttctctc

SEQ ID NO: 8329 - DNA, 162 bp, Homo sapiens
tttgtggaaggtgaattattgcaattttatcttacaacacaatagggaatagtgaattgatatataaatattatttatgaataaaatactaagactacgctagttagatgttgcaataaatcgaaaagggatatatggtgcataaaaagcaatgcgctatgc

SEQ ID NO: 8330 - DNA, 450 bp, Homo sapiens
gtacagcttaattctatgctttgtcctgcacctatcctgaataaagctggagaaactcttgatgtttcagtgagctttaatggaggaaaatctgtcatttcaggatcattaattgtcacagccacagaatgttctaacgggatcgcagccatcattgttattttggtgttactgctactcctggggatcggtttgatgtggtggttttggtccctttgctgctaagtggttattaagggatcctccaccacccccccctgcaccaaaagaggaggaagaagaacctttgcctactaaaaagtggccaactgtggatgcttcctattatggtggtcgaggggttggaggaattaaaagaatggagggttcgtggggtgataaaggatctaatgaggaaggtgcgagggtagagaaaggcaaaaatggtgtggtgaagattcctgaagaaaa

SEQ ID NO: 8331 - DNA, 229 bp, Homo sapiens
ttattcagtgtatttttaggtggtattattatgtttattatttttctcattgatttagtgactatatcttcatcatgttttcatttttatttgttccgaagctcccggaaaatctaacttgctaacaattatttaaagggaggagagaggaaagcaggagcagctgcaggaacagcagcatttttgggtacctgcccggggcgggcgctcgacaatcactagtgaattc

SEQ ID NO: 8332 - DNA, 370 bp, Homo sapiens
ggtcttttggtgggagttgagcgcatcaatttggggtggtgtatgatccatgtttatacacattcatgcttccataatgcggttgctatagggatacgagtgactttcgtgagtgccaatttgacatcatgtctgggcacaagatctttatgtgttctaaattgagaggagatgatctatgacatccttcacttttatcgggtaatactacatgtatagttcagtaatgcgggagggtctctatagacattttgaatttcctagcataatgtctcaggaccgtggtgaagcattatatggtttttccaatacatggttgggacgcaaggcggcgtgtcacgtacggccacaggcagttcattgcccgggc

SEQ ID NO: 8333 - DNA, 530 bp, Homo sapiens
ttcatgatgggttactcttttatgtctgaattcatgtttatatatgcgtatagtcatctatcgtatatctataattatttataatatgtgttatctgcagtgataaattatgatcttgatgtcggtggtgatgattaattgtgtgactcgtcattactatgaagatgatcttgaggctggtatcgtctgtgcatgaaggtgattgagtgctggtgcacaggattttaaagatggctctaaagtgtgcatagaggttggtgttcagacaaaatatgaagatgagctaggtgatcggatgatggaaatacacttgtggagcgtgattctaagactgaagactcgcttgatgatatcctctaagatgaacgagtcgatgctgatctccgcgttctcaggggatcactgagcgatgaaagacaggatgaggtatgagtgtggtctcgacggccggtcggtgctggtggccgttgggatgtgacagcctggagatgatatgtgcataacgagatccagatgacaattccaggctg

SEQ ID NO: 8334 - DNA, 306 bp, Homo sapiens
gatgtggtggtggtctctattgagcatgtgcatgcactcgtgtagtactggaggacacagtagctctacagcgtcatgtggcagaggataatgatctggctagttgtgttttatagaagcagctatctaacagctctcgactcgcgaagacgctctgtcgggattggctgtaagcactacggatgtcacatggtgtagtggctggtctgcaatgagtggtgctgatggctccctgtggttacgagtctgtattcctattcaccgaagggtgtgctggagtgtctgtctgctgtctattaatacacc

SEQ ID NO: 8335 - DNA, 178 bp, Homo sapiens
atacaaaacgcgcaatatctaattatgaacagcgttaaatccctatcaaagttcaaatgaaatgtgtggcttatagtgtgaatgcacagatatatagccatatcatgtcatgttgtgtgcggagttggggtgggaacacgcagaaccggagccacgtcagctacacctcaaaaagtgc

SEQ ID NO: 8336 - DNA, 162 bp, Homo sapiens
agagggaagagggttaaagaaagatgataagaggatcaataaattaattttatgaaataaaattaggtcataggggtatggaggaaataaagaattagatgattatggtaataatgtgtaaaaatgtgattaagtgtaaagggaggtatgatgagaggatgg

SEQ ID NO: 8337 - DNA, 338 bp, Homo sapiens
tgataagatgtgaatacatatagtatcatactatataaataattcttggggtgtactatgtgcacaacattaataagtatatgggaacatgttcggcttatgctgcgttgcgatatattgtgatacagagggatctacgtctaggtatgctgatggaactagtacgagtgatgctcatatgaggtctgcctagcgtccataggcagctccacatgtacattcactgaaatgttgttgtgatatctgcactgaggaagcgcgtaggttatatgactttgtcatatttggtcgtgtataggcataatggaattcattcagtttagtgcaggaaagcacac

SEQ ID NO: 8338 - DNA, 610 bp, Homo sapiens
ctactttgtatcatctcttctattattttgaaagactgtttaatttttcatgtcttacattcccaactaaagacctaaaattgttttgtatccccactcaaaatgccttacagaaaatacaaaaatcaatttgatcgtttccttaattacaggagtcattgcaattagttacataatttgactcttggctatcagagttacattatttgaacttaaataaccatcttcctgtaactgaatataatttatattccctatctccagtaattaactggcataaaatacagaaataccaacaacaagtagtgtaccccactggtaaagtgcatagactctgtggttagacagactatataggattgctgaatcagatactacaatacatagcagtatgaccttaaaccattgtattaagtcatctaatcttctatatcctcattgtcaaaaaattcgtgtatcagctacgtacgaatactagtgtatgaccttccacaatcggcttaagctctctactaatcaatttactcatagtacaaaatggggaagaaaacagtatggtgttcggaacgcacacagtgactgatggagagtatgtgctagggagaaggga

SEQ ID NO: 8339 - DNA, 194 bp, Homo sapiens
  misc_feature (1)..(194): n = A, T, C or G
tgaaagctatataattagacattgtaaatgccttagataatttatgggnattttatctgaagaggtaatatgacatattggattactttgtgagtgtgaatataaagataagagaaggatgagagaaggatggtgatatgagggatgtggatgagaaagaggaagagtgtatgagagaaatgggattagagaaa

SEQ ID NO: 8340 - DNA, 210 bp, Homo sapiens
ctgacatcaccgactcatatgcttattaccaccctgcttgagcaggctggctcccaacggagatgaacgaccgtgttcctgcctggttgttattcgacatgctcaggactgcggggagaaaggatgagatccagcagggaagaactgcctgctgccagcacgcaggagagggtggggctgccggccattatgtccataccaacacaatgt

SEQ ID NO: 8341 - DNA, 338 bp, Homo sapiens
ggtactcatggatccataggaaagcatgtcagtgcctggtggccacactatacatggaattgtggagtatgaggaatatggcacgaccctacctcttcttaagacagttgcagttcacagggagaggaggaagatacatcaataaccccaaagtccatgaaggtgcaaagagttatgtggggctgcccaggcagaggtgacaaatgcccactggtgacaagacactggtggacatagagggaaaagcccacatagaaaggtttccaggcagacaggaagtcaaggcagttggggacgggaagtcaaacaagtgatgctgggacaccgctttgatgggt

SEQ ID NO: 8342 - DNA, 322 bp, Homo sapiens
ttcctgataaaggggactttccatgccgtcaacagggaagtatctgaacatactgccttataccgattgtactcactatataaggaaaatgggtgcagtagtgtggttcactgagtcgggtgggaacaatgatggtgcagataactgccaggagtaactcattctggtgataatagatgggacgtgtgcagcaacacaaaaataagccgatgaaagaaaagtcctcaatagagtgtgctgtagtgtactgggcaccagtaggcctggtgccccctggtacatgttaccttcggcacgcgtaccatcgcttattcagtaagtg

SEQ ID NO: 8343 - DNA, 178 bp, Homo sapiens
tgttccagaagttataagaatgatatactatcgatttttagaagatggatgaaaaagttgtatgctgagtcatacgaatgaatgaggtagacatgggaatgtaagtgtcaccatgttgtgatatgtgtgatcttagggtaaagatgaatgaaatatagtgagtatgctcccattcttt

SEQ ID NO: 8344 - DNA, 160 bp, Homo sapiens
acctagaattaaaaccaagactctgtgatcagaaatcctcaggcccggtcccttgttgcctgtagacaatgaaccaaaagatggcgagttcaacagtgggacacaggctgggcatgatggctcatggctgtatatcccagcactttaggaggccaaggta

SEQ ID NO: 8345 - DNA, 194 bp, Homo sapiens
gaatttagtaaggctttgggcataatgaattagaagcgggaagaggatttgtgcagataagttatgcttcggggctacttctcccatcaagtcaaatctcgtctgaattctggctatctctctagccatgttgcttccgcctctcaacaattcaactgggtggttgaatttagactccgggttctaatcttggt

SEQ ID NO: 8346 - DNA, 226 bp, Homo sapiens
caaaaattgggacgaagaatgatgaaaagtaaatttagaatgtgctgtgccgagaatgaaagaaaaagcagcgtggggtctgcgtatccagactgggggagtggagcaggaaatcacttagcccagagtggcgagaaccctaaaaataaaaataaaataaaataataagaaatggagcagaaggcgttcataggagccaattttattaactaaaccaaacccatga

SEQ ID NO: 8347 - DNA, 546 bp, Homo sapiens
ttcagagcagactaacgtgggctgccattatttctatttatatgtataagagtatgtcttcgtgatctgtataaaaagtgatcgtgtgaaagatgctgattgtcagtatgttatgtcaatgtaatcaaacataattgatctctttaatggtgtaggagatgggattgttctttgttaggtgatgatactgtcagtgacatacaaaatagatgaaagattaatcaatcagacgaaactacgcttatcactaatgaagaaaatgtgaactgggggttgaacataggcgtgagcatcgggtgccttggtggtcataatagaggtatgatgatcgtgtggaggggatagctgatctggtcatggacttctgtgggtaggtgtgaagatgtgttgtgtgctgacatcgaactcaatagaaatgaggatctgattgtgctattgatagagtgtgtgaggcgtgaggatttgctgattctctgcgctgaagagctgtgctgatgtgggctagttaacctgtggagacatgcaggctgcaatgaatgtgggcaa

SEQ ID NO: 8348 - DNA, 354 bp, Homo sapiens
tgagtacttgaaaaaatgaaagtgagagatgtaatactgctggagacaagtggtctacttttacttctaacttgtaatcaatgtgagcgatgatccattatcatccaaatagagtgtggagactatcggaggatacgtgagtgtcaagtattccaatagcaattaaaacaaatgacatgacttcgagacagctgactacttatttcggtaatgtgatttgaatgtgcctggcagtcgcaatatatgagatcgttcacgtgatggctgatgtgtcgccagcatattatatagggtagcgaaaatggagtgagatgctgttgggaggtcgatgagcatgtgattaatggttgtctg

SEQ ID NO: 8349 - DNA, 162 bp, Homo sapiens
ttttttttttttttttttttttttttttggtgttttgtgcttttattttacgaaaaagctaatggcaaaatctacatttaaactatagatgaatccaaagcctttagtgagagaaaggctggtggggtgggattacataaaatggaccagtgggcatatctt

SEQ ID NO: 8350 - DNA, 210 bp, Homo sapiens
  misc_feature (1)..(210): n = A, T, C or G
ttngtgaggtccggagggtacatgctgtagtgcccaaagttgttgtgctttttttattaagtatagccagggattacgtaggttcaaggtcccaccagataatgtccttaatagaaattatgttaaacatttatattcctctacaaaataccttattttcccaaataaagattaataattaggcaggtattaggagaattaaaaaaactc

SEQ ID NO: 8351 - DNA, 162 bp, Homo sapiens
gctatgacagaatcattgtatgtgagcttaaggtctctgcataaaactgaagttaagtagggtagcctgcccgccaccatgagctgacttgaagagctactccctgcgtgtaagtatctgttggcacagtatgtagtggggcgtacgattccagaaacgcac

SEQ ID NO: 8352 - DNA, 854 bp, Homo sapiens
  misc_feature (1)..(854): n = A, T, C or G
ctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacaganaggtgtggcatttggaaacgggaataaacaaaattgctgcaccaatgcactgagtgaangaagagagacagnagatcaaaggctttagacagcactccttcaatatgcaatcacagagaaagatgcgccttatccaagttaatatctctaaggtgagagccttcttagagtcagtttgttgcaaaattcacctactctgttcttttccatccatccccctgagtcagctgggtgaagggagttattttttcaagtggaattcaaaccaagctcaaaccagaactgaaaatagagattgcaggaatccttttctaaactgctttgccctttcctctcactgccttttatagccaatataaatgtc

SEQ ID NO: 8353 - DNA, 642 bp, Homo sapiens
ccgaggtacatcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcagttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtgggatttggaaacgggaattaacaaaattgctgcaccaatgcactgagtgaaggaagagagacggaggattaaggggtttagacaggactcctttcatatgccatcaaagagaaagatgcgccttatcccagttaat

SEQ ID NO: 8354 - DNA, 338 bp, Homo sapiens
  misc_feature (1)..(338): n = A, C, T or G
ggcaggtacactagaaagtcttttacaanaataatcatccttagatcaaccagaagaccaatcttcaatgtncgtcctngacagagatgggttacnntttaacatccctcctcctggttttcgtcccaatgttcctcctttaggtagtggcgtggtaagttggttgttggtggattgccaccccccctcggaggaatgcccttgcccataaggtgcctctgggttggcccactggtaaggtcctgcaattatcccctggtccaataatcccattagttccccaataggttaataccccaagttataaattcataatcccgccccataggcccacttat

SEQ ID NO: 8355 - DNA, 498 bp, Homo sapiens
aatcgattgaaccgggaggcggaggttgcagtgagccgagatgcactacactccagcctgggcaacagggccagactcatctcaaaaaaaaaaaaagaaagaaaagaaaagaaaagttaagtgcagagaatagtgcctgacacacggtatacagtaggtgcaatttcagtattagttgctactattgtcataatcatcagagtgtttcaagagctgtgcctccatggctctccacatcgcttcacaaactcccctgttctgggacccagcctgaattgtaaactccacccccgactgatgctaccctataagccaaacagaatcatggctggggtaggggctctaccctttgggatctggccgaaccaggaagaggtagagtggcctggaggccaaccacaggtgattcagaatgttcaccacgtggttcatcctgtcttactcctgctttacacgagaagccaccatgactagtcctcctcctgcggggacagacct

SEQ ID NO: 8356 - DNA, 242 bp, Homo sapiens
tgggtggatggatcagtggacaagttagtggatggatggatgatgaatggatgggtgagttggttggtggatggattggtggacaagtgagtggatggatggatgaataagttatttggggagacaaatggaagggcaggaagattgatgctccgcatgttcctggctttctgcactaactgtactcgacgtcactagaaaaaaaaaaaacaaaaacaaaaaaaaaaaaaaaaaaagtctgg

SEQ ID NO: 8357 - DNA, 756 bp, Homo sapiens
  misc_feature (1)..(756): n =A, C, T or G
tttctttcacctgtcttctaattagagcctcttactcatctgtagcacgagtcatttattttgtctagtacaaagaatatttcgaatactcatgactaaagagctcaggagttctagctaaagaagaatcttgaagcattggagttttgaaaatctgcataaagattttgaagattttttaaagattcatattataacagtataccgttggtctaatttttcttaatctactaaaaacgaaatagcacaggtcagatgtgacttgcttgctttctgctcctgtacaatccaggagtgttaatcaaaaagcaaaatttgtgacatcagttttatttccatggctactgattgtaatattacaaacatgagattactggctagttcatcatgaaggttaaagaagattcctccttggataggatctccaaaaccaacaccaaagggaatattatcagagctgcttccagcagcgtgtcctttcaaaaatgttctcattattctgagagctttgttttattttgtgagggttttatcatttgttgttggtggttaatattttaattttatgtgcttgtttgttttatttattcctccaccccaggtgaccgtgtangaaaatggttattttagatgtnagaagcccctctgttaggaagcagtttctgccttcgtttaattcttcttccacaaataagatttattttggaacttcagtcaaaaacatctgtactttgtacaggacaaagatttggcttc

SEQ ID NO: 8358 - DNA, 370 bp, Homo sapiens
  misc_feature (1)..(370): n = A, T, C or G
cctaagtcacagttctgtcggactgtgggtagaagactaggagatggtgagtggagtgtaaggaccacatgccganagaagattgatagaaaccatgggtaactgtcgaatctgtcagtcccggcatgagtgtaattgctttctctggagggcctggcgattctctcctacccagtggctatgctttatctatcgagcttgtgcccggtctgcatttctgattatgttgttgtgtattgtgtgtatgtatgtattcgtgggaagagtgtgttcatctgaagcctgtggctgaggattaaggttaggattgggtaaagatcagaatatcacgtccagatatcgcagcgactccctgtggatagcccttggg

SEQ ID NO: 8359 - DNA, 626 bp, Homo sapiens
acactggctgctcggcagtcacgccggtggccggcgggagagcggggagaagcctgggtccgtctggctcttaccacaccatgctcctgcttccacatggcagagggacagtcagcaggtgtgcagcgccccagctcctacttgtctcaacagtcctaactggccatggccaagagttctgtcagggcaatcaactccctgacacaggccagatggacatccgggagaaatccatagtactggagctggttcagagccccacggaattaagtcggaataaaaccacgagagaaagaacattttcatgggccctgcacggagcctcctgggcctgatggagaggggccccacccagaagagcacagggctggcccccacccctgcaccacacatgcgctttatcaactgaacactcccacagccacacggacaggattcattcaagtctgtgtatgtctgagcgcaggagaagaggatctactgagctctagctggagcttcatccagcgatgattactaatctcgtgctccaatgcagctcccatcctctcgaaggggatggtcggcgaccggacgtctacgtcttggggcccgttccccgagctggggtatctctgacggcttta

SEQ ID NO: 8360 - DNA, 210 bp, Homo sapiens
ggctgatcgtgctcgaggaggaaaggaaccgtaggttcacgacattgggtgtatgtgctcggctgaggagtgaatggggcgaagcagcatctgttgggatcatgagtgaacggctctaagtcagaatcgcgaacagagcggaaagatagggcagcggcgcggagggtcgggtggcctgggatagcgggtcggcgggcatgctccgggggg

SEQ ID NO: 8361 - DNA, 338 bp, Homo sapiens
gcaggtaccaaaataagaggagcgggtgcaggtaactgatatttactgaatagtaaagagggaagcgtgaaggggccttggagaatggttaacagcatctgtttccagctcatcacaggtgcacagcataagatgagagttggctatggatgggcaaatcactgaaggtagatcaaagatgggtgctcagcgccagtcggtctcatcgatgcctagctgttatgtaattactggatcaaaactagatgttattagtataagatatatgtcagataaagatagtatttaaaattgtgttgtaagataagagaacacatacaaaaatgtggattcttaca

SEQ ID NO: 8362 - DNA, 578 bp, Homo sapiens
ggtacatcagtctcagattcatcccagaaaaaagaagagcacaattattctctttttgtctccgacaactggggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatgggatttatgcagtaaagaagtctcggagaactgatgtagaagacctgactccaaatcctataataatcctccagatatgcaatgaacttcggaaattgaattaggtgattattgatctgacttc

SEQ ID NO: 8363 - DNA, 194 bp, Homo sapiens
gagggtatataactaggggcatgaagtgtgagctatcgttaatgagaatgacgtttggtttgctatcgctatggctaagaatgggattaagagaggaagtggcaaaaaaagaatggacgtattatgaggttttatgccggagcgactgaatatacaagaatgggggagaagaagctttttagatgtccttaata

SEQ ID NO: 8364 - DNA, 226 bp, Homo sapiens
cgagtactaaaatatctagttgtttgatagataacttaaactcattaatgatagatcgtaaagatctatagtcagtctcacaacagatgaggtattatttgtatgtaagtttcagcgtttgtgattggtttctcttttggaataatgagagaataaagtgtgtattcttgtgttttccctgataaatatgcataaggggatggggttaaacagtgttgaatatctc

SEQ ID NO: 8365 - DNA, 306 bp, Homo sapiens
tactgaaagatatagttaaaagatcaataacttaaatcagaattaatgttacgtaaagtcttatgtttcacatcaacacagatgaggtattataagtatataaaagacggtgtgtggggaaagctaggggtaagtatataaagtgagaattcgggtgttgtggagtgagtgttgtggtatatgtgcatttgggttggggtggtcaagtggtgcatagagtgaggaaaccatttctgcttggggtaatggcacatctccttgcgcataatggtattgaatatcatatattctatggagaaagaagtg

SEQ ID NO: 8366 - DNA, 290 bp, Homo sapiens
gaggtactgaaaagactcagtcagccccatcatgactctgatgaaaagagaggatatgttcagaactatggtcagtatcttccctgtctaagggattataagtatcttcccctggcagagctgagggggccataggtactgatctacagtgatcacagtcttggtgtgtagagagtgatgacagctagctcgactagggagggagtgccaaaaggtgaatatggtgagagaagcctgtgtgctgatggatgtttactcatctcctcggacgtggacgatattcactatct

SEQ ID NO: 8367 - DNA, 290 bp, Homo sapiens
aggtgcatattgaggctacttagaggaatgtaagacaaaatcctgtgaataataagcatcactcagaaccaacagcgaacagatgtagtgttgtagagtggataagtactacaaggctcacaatactacggattattattattaattggtcttcgtgaatagaaagtatacggggactacggagaaaagattgctactgagtcatgattagttataagaggatgagtaacaactacaatgtgttctgactcattgtgtgacccagcaccatcaccattcctatgcatctc

SEQ ID NO: 8368 - DNA, 466 bp, Homo sapiens
taccagcagagtcagtggggctagttgttatgtcctgtatcagtcactggtgatgggcctacctcataggagataaagattttctatgtagatgcaagtaaagtgagtcggtgtagaccagaataatcctcttctaaagaagggtctatggatgttctagggagtatgatctctctgatgaaagatcaatagttgtctagagtagatttttatttcttgggatgttgaggtgggaggatggttagatactataaggtagcggttgattgagtcgagattgtgtcaatgcatcagacttgtgtgatagagtgagacacttggtctgtttggaatctggatgatattggtcgtctctttctgatggtcgttgtttctccactgtatagatcatcatgatagcatttggctgagtaatatatgatagaagcgctgtgcgggagttggaggatagagatgaatcggggta

SEQ ID NO: 8369 - DNA, 194 bp, Homo sapiens
gggaggtaaaataagagggaggagggggtttagggaaattgattttagtggggtatatagaaaaaaaaaaatttggagggagaagattaaagaagttgagataaataaaatataaataagtgtattaaaaagaaaataaaaaaaaatggttaaaaaaaaaagtaaaatataaattttgaaaataggtgaatagt

SEQ ID NO: 8370 - DNA, 226 bp, Homo sapiens
gaggtggtggttgaggagaggttataagggaaaggataaagaaaatttattttatttataaaatggagtttttcaattttaatttggaagttagaaagggataaaaaaaaaaaaaatgatgggtataaataaaataaaagaaaaatttagggtaaaaaaggttggggattttgggatttgggtttgaggttttgaaaaaagggaattaaatatttttttataagat

SEQ ID NO: 8371 - DNA, 210 bp, Homo sapiens
atgaacaacttaaaaaaaatacaaaacctggatcaatggggcttctgggaaccgcgtatcttcccctcacccaaggcagtgggcatgaatctacttttaaaaaatgattaattttggccatctgagaagaaaagagcctaaaattgggtgatgcaacgagaaagtgaaagtcgagggaaaatgcagtttacaagtctctgaaatctaatg

SEQ ID NO: 8372 - DNA, 306 bp, Homo sapiens
gtacaaatcttatgtggtacataataaacattgtaaataactaacattctttacacatcttcattggcctgctcatctatgtttctaagccaataggtgatgttttaaaattatgtacagtaggtgatgtgatataataacatgaataacatagagcctcagaattagggagtagtgatggtgtgaaatcgattatgggcatctgtatcccatatctgtaactagatattttttactagtaattcaacatgttttgatcttgaagtatattactatagtgggaataaaggtaataaagaaaggatc

SEQ ID NO: 8373 - DNA, 386 bp, Homo sapiens
actttcaaatagctagttggatagtttgaattgtataacagtaatacctggataatacttactcgtatatgcgtgattaatacactctgaatcatatagatagtgattgtatgcatgatctgcgagtcattggttaagagctgaacgactatgtggacagtatgttaaacatggaaaagatggaacacaaaagagaaaaggatcccaatgagaaaaataagaatgattattagtattgcaatgtgaaacttaaagggaagaaggaaaagataaaaacggattggtattactgaatcagttgaatagaatcggataaaaaacaagcagggatagcggatcagacatgtagtaaaagcaactcgcccgatctggccgcaaaaagcacc

SEQ ID NO: 8374 - DNA, 530 bp, Homo sapiens
atttatttcattgctgaccattaggttgcagcatgcaactctcaacaatgagctgcccctctccactcctatagaagctccaaatactatggtaccactatgtaggttttcagcctttcaaaggcttttattattaacatcatcattacagaataaacattgtactaccctcagggaccaaggaagtacatagggttgttttccttttcttaaaatagccccagaattatgtttgctttttatagcttttttaatctctcttgtcacttcttgctattaatggtgctcctgcctctgggactctgccggccgcctccacccacgacttaaacaacatctcaccaattgcaaccggatcgtgggtgggacttccgctatcattttaggctttactaccaccatctcctcgcgggcagtgggggcaaccgcgaagacagaatttcacaaactttcagctccagcagtttcaaggaaatgttaaatgagaagatggaagaccgagtgtgaagagctaagaaaacaaaaagggg

SEQ ID NO: 8375 - DNA, 335 bp, Homo sapiens
tgaagggtgagctcctgggacctcagacagatccttccctctgatcctgccctgttgttggtatatctggggagtgtgtggcccagagaagccagtgatatatccaggtcacacagcaggcctgggtctagcatctgtctcctggcctccaggccattgtactctccacagcacaagtccgcctctcaggttcttttatttacaatgaaaccatttacttacacagttatcgctgcccactgggcattctttgggcagggagatggagttttgttaggtgggctctgcatacctatgggaactcagtgatgtaatgcaaagaaaaataaacttac

SEQ ID NO: 8376 - DNA, 482 bp, Homo sapiens
ggggggtggtggggagacgggggctttggaaaggaagcgccggggagaccactggtgttttagcgagaaggggggagcctaattcaaagccgggggggcggagccgataatagggtgtggggggggctttggggattttcggtgtgggggggggcttccattttttgggggggggggggggggtgagcggcgactcctcggaaagaaaagcgggcctggcggggggttggggggaggccaagtccggggggggggggctgctttttttcccggggaaaatgggtgggggcaaaaaagggggggggggggggggcttttgccgctggttaatttgtttcccttttcttttaattcgcccgggggagttttttttttttggagaggagggggagtaaaaggttatgcccgagcggcaacaaatattttgacagaattgcgccgccttgctcgtgaacaaagagaaaaagaagaagaaaaaagac

SEQ ID NO: 8377 - DNA, 322 bp, Homo sapiens
ggcccacccgcggtctctggccacctgttgccgtccatcacggggccacccttcttcatcctccgtcctgtacaatagctcagcaaagcggctggcggactggcccgggatctgctgctgctccagccatctacatgacaaccagagcctgggaggagctggatggcggcctgggcagttgctaagccctggaggactactctgtgctggccgagaccgaggaagacagggcttcagcgatactcaggctggccgacttcggcagcgcgccccacgactttgaggtggctgaaggctggcatgtggacaccaggaccaagaa

SEQ ID NO: 8378 - DNA, 162 bp, Homo sapiens
ttagtttggttgtatttttagattatggtataataatttgaaattataaatataaataagtagttagaaagggtttgaattaataatttggtgaacggttttaatcgataggtgttgattagatgaaagttagtagggtgatgtttattatggttgatagtt

SEQ ID NO: 8379 - DNA, 258 bp, Homo sapiens
aaggatgcaactcctgtcttggatagcactacgtcttgaccttgctcaaaacggtgctactaaatcaagtactacacacaaaaatgactggcaagaggagcatgtactgctggatttatagatgatttggaatggaatttttacgttctagaatccctaacccaccaggatgctcacatatatgtttgacatgccacaagaaagacacagacaatgaaacatcttcggtgtctagaataagaactggaacgtcgcgag

SEQ ID NO: 8380 - DNA, 162 bp, Homo sapiens
tattgatgagatctcccatatgatacttctcagtcatgtaccattttggatattcgctctttcactgtatatattgtgtcttgtgtttggagtgtaagtctcagatcagaggatctgttgagtctatagcataaccaaaatggagctgctaggatttattca

SEQ ID NO: 8381 - DNA, 210 bp, Homo sapiens
  misc_feature (1)..(210): n = A, T, C or G
gctactagttatcctactaagagaaaaggcaacatggacagcttcaaatttcgcaatgtaagactagccattaactggggcctggacgtgcgcggcttaactttggacataaccacatagcgataaattttacgaccccagtgaaaacaatgatttccatacccagctcttattccttcaccataaagattctgtgtnagcaatttaaaa

SEQ ID NO: 8382 - DNA, 562 bp, Homo sapiens
ccatagtccctgcagagatgaatccaggtggaagaatgcagaaaagctttagaaggcatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcacgaaattcaaaagaaaatgtgggacgagttagatctatggcattccaaactaaatgagctggattctgaagttcaggacatcgttgaacaggacccaggagaggctcaagaatggatggataaattgatgattcctttcaagcagtatcagcaagtatcacagagagcagagtgtagaacatcacagtagaataaggccacagataagatggaggaatatagtgaccttctgaagagcactgagggctggatagaaaatacacgtcatttgctggccaatcctgctgactatgaatctttgggggcactgagttaccatggtagcgatgtgcagatgggttaggaagaatcaccagcggaagcaa

SEQ ID NO: 8383 - DNA, 242 bp, Homo sapiens
actggcagctacgagcaaggccagcccgcgcagcacctagatagaaggcacgtggctgcatcccgacggttacagcctcgcgtctttcgggactcgctttctcctgttcgcgagtcgtgggctctgggcgctttatcccgaggaatactatgacagtggacatcaaaccgagcgctatagcaaggcagaacccgaggagggagaaagacgggagccggtccttgaaagcgccaggagacagc

SEQ ID NO: 8384 - DNA, 697 bp, Homo sapiens
tggctgcgcactcggcctgagaaactcggcaagcgcgcagtgtcgactccccggtctatgccaggcgcatctcaggaacgaggtctcactatattgcccagactggtctcgaactcctgggctcaaacagtccccctgcgttggcctcccaaagtgatggaattacaggtgtgaatcactgcatctgactatggcaaggatctctgtcactgaggtaagtttggcttagagattaaagctccttctatcttgtgatgccaccatcacaaggttctcaaggttgttgtgggagaagagaaggctaaaggagctcatagaatgcctttaatgctaatccaaaagtaaatgagaaacttagaaaaagattgccaattccaaatcaacatatttagagaaaattggaaaaggagaagcttactacagctttatttgaggactttttaaagaacgctgggttctatctgtgagctgcaaatcttggagcaaaaaccagagacattgccagagcaaacaagaacagaaatacaaatggagaactggtcaaaagacataacccacagttatcttgaacaagaaactagggggataaataaaagttcggaggcagatgaggcaatgaatatgaattctgagaaaagtatggattggaaattcaatgaattaatttaatgaaattaaatgtgagaaaaaagaaagg

SEQ ID NO: 8385 - DNA, 386 bp, Homo sapiens
aggtgagttgggagtcagttcagaaagggcagagggtcccacaacaggaccagaacccagcgggggaacctggagagccccctgcgtgggccaacttactgttccatcgctcacccacctcgcgtccacagagagccctcccacactgcctggcctccctggccaccaaggcgctgccagaagacaaggtcaccagataatctgtcctcagagagggctgagaacccacccggggcagtatggaggaaccctaaagagggagaaagcaaaatgggtgagagtccaagggagggagggagagagagtggctgcagcgggagctcagaggagggaggaggctggctgggatgcacttgtcatgggagcaggtccagggcgggcaattc

SEQ ID NO: 8386 - DNA, 418 bp, Homo sapiens
gacaagcataagtacatactggaattaaaatactctaagaagaagaatcctaatgcatgccaaataagttctaaatatgctaaaccagccttcaataaagccatatgaccaactgataacaacaatctaaatactatacaaggtaactggcgcaagatttgatggagaaaagaccttcacatcaccacctcagtccttcacaggccaggtcctcctctctctgagacagtagggctgaacccggggacaccccagagccctgtaacacgcagccagcagtctgctgagctcgttgtgcagacgacaaagggaacacagaacttgggtctcaggggctgggcaggcagatccaagcatgagcaattagatcaaaatagaagccttgtttcaaagaaaaaaattgtattcttctaagtga

SEQ ID NO: 8387 - DNA, 370 bp, Homo sapiens
ctgatggcggtagcagcgcccagtcgagcacggggcagcggctgccgggcagggtctggtgcgcgaggggctggggcggaaggtcgagagggcgaggactgtggcaaggtggggctgctgctggagccctcatttgagatcgatgacagtgacaacttacggaagcggggatcaatgatctggacacagcaggatggtaccttgtccctgtcacagcggcagatcagcgaggaggagcggggccgactccgggatgtggcagccctgaatggcatgtacagggtccggatcgaaaggcgaaccggggcacctggatggactgcaagctggtggctatgtctcactcctaagtcaatgcgtgacccccgct

SEQ ID NO: 8388 - DNA, 226 bp, Homo sapiens
tactcgaatcgttgtgattgttggctgaatgtttcaggctatatatgtaagagatagtacatacatgtcttattcttaactccaagaatgcgtactttaggtgagggtattatgaatatgattaatccaccatgtaatcatgactattttagggtcattattggcgggtatggtgtatccatagtatcctctagcttctggcaaatgatggtgactgctgtatcta

SEQ ID NO: 8389 - DNA, 274 bp, Homo sapiens
aatgatgttggattatgttgcctgagatagcaacagagggataggtggggcggtaaggaaggtgtatgatcttttcgctatggcggttaccagtaatatccaggatcctattatcgagtcactcgtctacatatgtggctgagggcaatgctgtaatgtgaaattcgactgtatggtggtaagataccatatgcctgcggtaacccttcgatatactctggaatagtactgatttggttcgtttttcaaaggtagagcttgactcgacgaaccc

SEQ ID NO: 8390 - DNA, 162 bp, Homo sapiens
gtatcgtgattgtgaacagattatggtgcaagtgttattgaagaatccaagtgaagtaagggacaggcggtgtatcactcaaaccagtgggataacacaggtaccacactacatattccttccgtaggctggatacaccatgagtcttgtcatagaacagcc

SEQ ID NO: 8391 - DNA, 194 bp, Homo sapiens
  misc_feature (1)..(194): n = A, T, C or G
atgtctgtcgtctccatacatactggggtgtacagtagatgtgatgtcagactcangatggttatgtagtataagactgtttaaacctgctgccatttgattgacttcaacagaanagtagtactcccactatcggatagtttcagtgagtgataatagctggctcggatagatgtcatggattcatcccagtc

SEQ ID NO: 8392 - DNA, 162 bp, Homo sapiens
ataaaatgaatggataagagtgtggataaactaagaaggaaggagagggtaaagagatgaagaagattagtgatggggataggggattgaaattattagaaatgaaagaggaatagaaagaaaagtgaaggtattaagattgagttgataaagtaaaaggaa

SEQ ID NO: 8393 - DNA, 258 bp, Homo sapiens
agtgttagatttaaggtatcttatgaacagaagtaaattagattgataggaaagaaatagtaatggagtttgagtaaagaaaatgaatgatgtaataaaaaaagtaaaaattgttgaaaatgtgaaaggtgagagtgttataatggggaatgtagatatagaggtaatttaatattggattagagtattagatataaaaaatgaagtgaaatgaaaattatatattaataataggtgataatggtatgtatttgttat

SEQ ID NO: 8394 - DNA, 242 bp, Homo sapiens
ggtttggacacctgggggggcccaaacacagggacaaacattgtgtgcggctgtcgcttgaagaaaagcaaaatctaccgggagggctgcgcgcagggccctcaaaaagggggggcaaaacaactttattttaatagggggtattggccggggggtgggcttactcgaggtgatcttggccccgcccccacccgggatgggccttaaatccataaatggcctggcctttttattgcggtcct

SEQ ID NO: 8395 - DNA, 386 bp, Homo sapiens
tggaggaacctcaggaaactcgcccgaggtcacagagtgggtaatggagacagcaaacatgtgccgaccacttagtgcacaccaggttcctaagggctcttcagaaccctgaaataatcctgtggagcagatgtgatatagacccgtatttcaaatgaggggatttgggctgagggtggttacgggacttgcctgaggttaactgaggtaacaagcaccagagccaggattcgaaccaaggccatcggggtcacaggcacacactaccccccttcctctgctggctctgacaactcaaaccgggctgcagcatgggtgtgctctttccaccaagggacccctggggtggggctgtttggcctctattaccgctccttatttcttat

SEQ ID NO: 8396 - DNA, 290 bp, Homo sapiens
ggtttggcgcatggataatgagctggacctacatgatgaatagaagcagggatgatatgataaaagacgctgggcttttattgatctggggctcctttcccgggggagtccggtgagtccctttccaggtgggtttgcactcacacgagtgggcgggattatcatccacaagctggccaagcccctacctgtgggaggcttgatggcagggcaccatggctgaaatacacgcttgggggaacagatcaagaaagaaactacgcaccaaaagtgagcggggcatgcaccca

SEQ ID NO: 8397 - DNA, 162 bp, Homo sapiens
tgcatccctgaacacctgtctgggggcggggggtggtgggggagggagacctcagccgagggactctgacgagatttggtgatgtcctacgggcaggagtcattgtatgggggtgtgggaacagtgcctagaccacagggcacggcctactcagaaggtgga

SEQ ID NO: 8398 - DNA, 226 bp, Homo sapiens
gaagagccctctgctggccaaccctgttggaagaggacactggggatgggagtggcgaggtgcagggccgaccggagacaccggcagaagaagagatggagacagacacggaggccggagtgtctgcggaaaaggagggggatgacacaggtgccctgctggccgacttgatcgactgcgcccctgatgatgagaagccagcacctcccatgagacccgactccta

SEQ ID NO: 8399 - DNA, 162 bp, Homo sapiens
accaaacaaactacaaaaggactcatacgctactagccgtgagagtctctcttgctgtgttgacgatgacgagtggtggtttctgaacctgattgacattgatgaaaacggatgcatgtaccataatgcgtctacctgacatgtgggttgcgagcacataga

SEQ ID NO: 8400 - DNA, 354 bp, Homo sapiens
  misc_feature (1)..(354): n = A, C, T or G
ggaagcccgtaagtccaatatagcagatgtcagcagacccagctttgcctgcaagctgaaagaggagacccttccttgcttgtgtctagcttctggtgatcgtcagctgtcctcgggatcctgnggttcgcggcacgtcatgaccatcttggctgctggcaccgcggggcatcctcctgggtcttcacactgccttccctccgcgtgtctcaggctctaaattagccctctactaataaggatgccaatcactggattagggttcaccatattctagtacaaattcatcttatatatgattacatactgcaaagatcctatttacaaataaagattaattaataggtcccaagg

SEQ ID NO: 8401 - DNA, 226 bp, Homo sapiens
aaactaaaagataactcgcgagggaaaccaccaaaaccacaaccctaagggcactgatgcaacccctcaagaattgtagtgggaacacaggtcactgccaccaattctcgttgaaacatgactcttcatcttatggaattcatatatatattctgcaaggacgaggcagcgaaatgtgggaagtgacgacactgatggggaacactgggactgaggtcacggagca

SEQ ID NO: 8402 - DNA, 386 bp, Homo sapiens
gccgcccctggcgaactccattgtcggggggcctctaccagccgcccctggcgaactccattgtcggggggcctctaccagccgcccctggcgaactccattgtcggggggcctctaccagccgcccctggcgaactccattgtcggggggcctctaccagccgcccctggcgaactccattgtcggggggcctctaccagccgcccctggcgaactccattgtcgggggggctctacgagccgcccctggcgaactccattactgggggggcgttacgagccgccccgggtgaactccattgtcgggggggccgtataaaccgtcccggtgaacttcattggtggagggcctctataaccaacccctggcataattcaaggctta

SEQ ID NO: 8403 - DNA, 354 bp, Homo sapiens
ccagaaaggcccgcacctggggaagctggcgaacgctaaccgggaggtttttcttccagacttgattccgggatgttgagatcgttattcgaaatagactaacattcgaatcgcctgtgatggaaggagtttctgcacccgtagcctggcctcatttattctgcaaatgtttattgggtccttgccctttacaagatcctgtgctgtgagcaagaacaaggctttcatgtggaaataagccggcctttggttgaccaaaccgaaactcctctgaatggaaaatcaagaaaaatttggaaaaaataataaaatgttcaatgaaatggatataaatattttcttgtttaagtaggc

SEQ ID NO: 8404 - DNA, 402 bp, Homo sapiens
acagaacgagactccgtcttaaaaacaacagcaacaacaaaaagatcttgatgcctctgatggagctgaacatttattatacagcaacagcagcaaggattgctggtgggcagactacactgtagggcacctgctcttctgtaagaatctgaaagacactattgtcagagctctgcccttttggaatgaagaaataattccccacatccaggaagggaaacaggtgttgggtgagggctctggcagcagcttttctggcacagtcgagccttgggagggtctcccggcaagggccatcatggagctgagcctgcccactgggtttcccattgtctatgaattgtacaagaagaggctgaagcccattgaagctcatgcaggtcccaggagaagaaaaaggtg

SEQ ID NO: 8405 - DNA, 450 bp, Homo sapiens
  misc_feature (1)..(450): n = A, T, C or G
gtgtctngacaccctccanaancaccaggagnagaaacagctttccttggccttcccagccaaatctccctctgcctctctcccctggtgacgacaatggctggggtcttgacttgccaagatctggaaacggagaaaggactggatctccaaacttggactgccttggactgaccctggcctgggaagtgtgggctcangactccgagctcaagtcagtctgttcccccaacccccaacccactgcatccgggtgaggaagtgggcgcgagcgccacagcgcacataggggtgttaggagcgaaagactggagacccaaggactgtggggctggggtggtgggggcactgctaccgactaaacaagtcggggcgggctggaaaaacgaagggggattcggtgatgggggaagccaagggacaagggaaaaaggaaagggcgcattcttg

SEQ ID NO: 8406 - DNA, 450 bp, Homo sapiens
ttctcttctgtaccttccctgcacagcctcctccccagcctggatccacagccaccatcccatcacttgcctgctgcaagtatcctcagcactgcgcacctctctcccagctggcagaaaccagccctggggaatccaactcctggacttctctacacctgcacacaggttggcaggagttgccagaggtcttggcacagcagcctggctggaatcacagagcaatcctcaaccttggccaggccctcactgcccacctggcaaatcctcaagtgtgaccctagtcatctttctccttttggggtgtttcagactttctccacaagtctcagacaagctcaagtcactcccacatgaaaaataaaaacgggctgggtgtggggggtcatgcctataattccaacctaataaatggtaatggaagaattcctgggaaaaaaaatcttaaat

SEQ ID NO: 8407 - DNA, 530 bp, Homo sapiens
gacaggacgagactccgtcttaaaaacaacagcaacaacaaaaagatcttgatgcctctgatggagctgaacatttattatacagcaacagcagcaaggattgctggtgggcagactacactgtagggcacctgctcttctgtaagagtctgaaggacactattgtcagagctctgcccttttggaatgaagaaataattccccagatccaggaggggaaacaggtgttggttgaggctcctggcagcagcttttctggcacagtcgagccttgggaggctctcccggaaggggccatcatggagctgagcctgcccactggtattcccattgtctatgaattgaacaggaggagcttgaagcccattgagctcatgcagttcccaagagacgaaaaagctgtgcataaagccatggaagcgtggcttgcttagggcaggggcggagcgtgaaaggcggcagccggtccctatcctgacaacaccctcccaatctgccccattcctctatgcctctcacctcaacgtgtc

SEQ ID NO: 8408 - DNA, 194 bp, Homo sapiens
ctcttcttggctgcagccaagattctgggggctggggtggcgggtggaggtggggtaggagggataggaaaggcaccgggacaggcacgcgaaggagggagccgcggaacaaactgtcggtttcagcaggcccccacgaaaccgcaagatctgcaacaacgatacacagcaagccaaccgacgcaggcagagga

SEQ ID NO: 8409 - DNA, 562 bp, Homo sapiens
ctcttcctgcattgtctgtggtgtgaccatagcagattatatttggttcctgaatgtttgtggtgctaatttctgtgtttgttccaagccgttcagtcatgccatgcgctgcctcggtagatggagtaatgtacaatgaactccatgagtctctccagggctgcctgcagcacgtcttttccaagtagcctatttggattcccatctcaaatgtcctggatgcgagcgtcagcggctccagagctcggggcgggtgaggtcccctttggggaaccctttcctggccatcgaggtcggggggctgccgtctgtgggcaggaggacccgaggggcagccaggaaaggcgatctcttcactgtgaaaagttgcccgggtgcagcgccttttccttctaccatgggaaatgcaggctgggcccttggggtgagcctgcggggctctggtgctgtccccgacccccaccaccaacagaatgcagctccagcttaaggaagcccaaacaagccacccagggagaacaaaacaccgccagcgtggattttccaaatttccctgggaaga

SEQ ID NO: 8410 - DNA, 530 bp, Homo sapiens
atttttaaacatccaaatatctgtaacatctgttataacacttgacatatgcaggtcaataaattaaactattgctttgggagaaatgtgcctgaattgttcactataagtctctgccgggagttattcattcaagtaaacaaaagatggcctatttctgaaaattaacaatgcgtagactggactgtaagtcgtgattccgtattttctcgagttactagctccatcattagcaacatgagaatgtgcaatgccaccatgttgaagtatgattaatcaacatcttttctgaaacaaagattttttttcccccattgcagaatttgatacaagaggtattctggttccttggggggctgaaaaaatctggtttacgctggttggaaccggggaattttctggggttaagctttttgctgggactaaaatcaaaactgcactgcagagcaggtgagggttcatgcgcgcgcgcccacaaacacacatatagagaattaaaaaaccatttgccatccatatgggaatattta

SEQ ID NO: 8411 - DNA, 472 bp, Homo sapiens
  misc_feature (1)..(472): n = A, C, T or G
gtggagtgtattgtagcatgagattaaggttttggcacatggggtggagtggggaccgaatgggatatctcagttttctgttgaagcctactatagacgttcctgtcatcgttcgactctctctcacgtgcgcactgccacgtgtgattagtatgtgaataccaccggtgtatgggattcaatggatatgcttgacgttagggaagagatacttatagtaatggggagtggacaggggatcttaatgatgcgagcctgccaggcgggaagcgggcagacttgcgggttcttcatgaatgcagagggtgttgggattggggggcttactgccgcgactgtctatgggaatcccatgagctggcctctactgatggaatatgctgtaaagaatgacggggtatggggatgggtanagtttgaaatttgaaaaaaaaaaaaaaaaaaaaaaaaaaaaaaaaaaaaaaaaaaagca

SEQ ID NO: 8412 - DNA, 854 bp, Homo sapiens
tcacctgtcttctaattagagcctcttactcatctgtagcacgagtcatttattttgtctagtacaaagaatatttcgaatactcatgactaaagagctcaggagttctagctaaagaagaatcttgaagcattggagttttgaaaatctgcataaagattttgaagattttttaaagattcatattataacagtataccgttggtctaatttttcttaatctactaaaaacgaaatagcacaggtcagatgtgacttgcttgctttctgctcctgtacaatccaggagtgttaatcaaaaagcaaaatttgtgacatcagttttatttccatggctactgattgtaatattacaaacatgagattactggctagttcatcatgaaggttaaagaagattcctccttggataggatctccaaaaccaacaccaaggggaatattatcagagctgcttccagcagcgtgtcctttcaaaaatgttctcattattctgagagctttgttttattttgtgagggtttttatcatttgttgttggtggttaatattttaattttatgtgcttgtttgttttatttattcctccacccccagtgacccgtgtagaaaatggttattttagatgttagaagcccctctgttaaagagccagttctgccttcgtttaattcttcttccacaaataagatttattttggaacttcagtcaaaaacatctgtactttgtaacagacaaacatctgccttcctaccagagctgctggccttgctgatgttagataaatgcattttgttctttgaagcccctcatagagaagagactgtaccataagagaagcccactcattttg

SEQ ID NO: 8413 - DNA, 594 bp, Homo sapiens
  misc_feature (1)..(594): n = A, T, C or G
tggctcctnagacttgttacctcaagtagagatgttgggtggacaaccccattcccatgccaggcattctctccactcatcaaaccacagtcttctgctctgttttctgtttgttttgttttgtttttttgagacgtagcctgggcaacagagtgagactctgtctcaataaaaacaaaacatacaactacttttgcgggatgctgtgttttactgttgtgttgttttggatctaacacgccctccagtttattcactcttagccagtttttccagccatatcttttccttgaatatgtccagacaatatttcatggatcaaaatattaacaaggataagatgaaaatgataaaaccttgtgcttttcattttcctacacagttttctgcatgtatcttgtataactacataaggtatgttagctaaaaaaaataaaagtgtgtgtttgcagggaagcggaggcgggggcgcgctggtgctgagtggagtcacagtaaggctgtagatggagcgccctgggaagggtggtttttttgggggtttgctcaccccggggaaggaggagtgagggtttgaggatgggtggaggggta

SEQ ID NO: 8414 - DNA, 162 bp, Homo sapiens
  misc_feature (1)..(162): n = A, C, T or G
ttgntggtgatctacattagaggggtaatattattattttttcattcttctgttatggaaatgtaaattattttactatgtttctttttatgagcattgtaaagattttatgaatgttattattcatgtatgtttatgtctatattgagatagtatgttggt

SEQ ID NO: 8415 - DNA, 466 bp, Homo sapiens
ggtaatatgttggatgagacttacatagaaggggtatattttgataaataccttctaccgaaatggaagagtaaatatatataacttgaaacattttatgagcattgaagacattaaatgaatgatattattcctacatgtttatcgctatcctgagatgagttgttatgggtatgttacagtagtaacacttctgaataaataattgcagcattctaccatttaggtttatagggaatagctatggagggacggacactcttgacatgaaacttataaaaggacagcgtgagagactaaaaactacaggcctttctctctcaagaacatagatagatgaactttaaacataatgcttgctaactttatcctagcgacagattaaaagcgcctttgggcctccatctttttttgttggtggggctattgttgcggttggtgtaggcagcaacccagtctccttctg

SEQ ID NO: 8416 - DNA, 226 bp, Homo sapiens
aataggcaggttatgtggcttattactggtgagcgaataatgtaaacgatgagcgaggccggggtgcaggctctgcagggctactggtgaggcacagagtacaaattgacatttcactatgtttgtgtgggcagacacttggaaggtgtctcaccgctgcacgagtgtgaaggctgtgcatagatcattctggcgtcctgtgttgagagcagcctaatgctcacgg

SEQ ID NO: 8417 - DNA, 274 bp, Homo sapiens
acatgggtgaaagaacatctatttagtgtggagcagataacagccatgttgtttgactaaacgtgaaggaaaactgcgtggaaaacagccctcaagaaaacccagtaacagcattgtggttattttcaggtccccttcctttcttttacaggatgctggagaaggcgatcctgtgttaagatgcctgcacaagatttggtggccttaaactgttttaagacttatgaaatgacaatgacagcctgttgctttggaattacgggattttaataag

SEQ ID NO: 8418 - DNA, 290 bp, Homo sapiens
ttttttttttttttttttttttttttttttttttttttttttttttttttttttttttttttttttttttttttttttttttttttttggggagggggtggttttttggggggtttagggggaaaagggggggggatttttttttaaggtttttttttgaaggggggggttattaaaaatttgaaaaggggggaaagagggtaaaaaaatggaaatttaaaatttttttaacaaatattggtggggccggggcgggggggggggggggggggccggaagtgacaggagtg

SEQ ID NO: 8419 - DNA, 162 bp, Homo sapiens
gggggaaattctgagcctgtcagtttggaattgaggtttgacttgtggaaggtggacttcttgtgtatttgctgctgctgcttcatgctggtttgtgtgggctacctggttgattatcttgcatgggtgggtgttgttggtggaatttgggatcacggggtg

SEQ ID NO: 8420 - DNA, 210 bp, Homo sapiens
attatggaaacatgaagctatttaggggtttttttcccataaaggaatggaaaagtaatccttttttattggaaaaagaccattattttaaaaatttattgtttttctgtgtataagaacatcagttacaaatgaaatgttatcaaattaatatcctatgcttactaagtccaccttctggtccttatttacaaaaaggggccattggcc

SEQ ID NO: 8421 - DNA, 242 bp, Homo sapiens
attatggaaacatgaagctatttaggggtttttttccccctaaagggaatggataagtaatcttttttatggaaaaagacaattatttataaaataaattgttttttgtgttatagtaacatccagtttaccaatgtaaatgtatatccaatataattatcctatgcccttatcacagctctactctctctggttcttcatacacaaatagtggctattggttatccttttgtcatctcaac

SEQ ID NO: 8422 - DNA, 194 bp, Homo sapiens
gccgggtcagggtacacctcacctaccccacctccagtcaatttcattttaagttcatacccaaactataagaatatgtaataaataaaattcagcaagttgtattttacctttaaaaatacacctatcttcccactttttgttaagttatttttaacatttttatgttatattatttcctatcagtggggaag

SEQ ID NO: 8423 - DNA, 210 bp, Homo sapiens
cgacctttataaaataacgactaaaaccttgttgtggaattatggtatatagctctaaagaaaaaattaatctgggattatatttagagttagtagagaagaataatagaaattttactttacataactataaaacatggtctattattaatataaggactaaaagctttcttggtggatcttcaacaatttaattctgcactttatata

SEQ ID NO: 8424 - DNA, 322 bp, Homo sapiens
gaggtactgtattatgggaaaacatgtaaggctatttagggggttcttttcccccctaaagggaatggaaaagttaatcctttttttatgggaaaaaagcacaatttatttaaaaaaaataaattggtttttgtgtgttataagaaacacccagcttaccaatgtaaatgtttattcaaataaataatctatgccttaggaaaggtctacctttctggttcttattaaaccaaaaagtgggcattgggtttccctttggtaacttaaccgccaggggttccatttgggaaatccacccaatcaagtatggtaggtctggcgt

SEQ ID NO: 8425 - DNA, 194 bp, Homo sapiens
tggaccggaggtaccagggtaggtagctagatgctgcttccttagcatcccacctgcagccttgacaagcttcaactatccagcagctcctatatcacaaaccgcacctacacgctggctaaggaagttagcttggctgataacaacacagacgaacgaatcaacggggagaaaccgatccatggagctaggtc

SEQ ID NO: 8426 - DNA, 402 bp, Homo sapiens
gtacaagctttttttttttttttttttttttttttttttctttttttttttttttttttttttttttttttttttttttttttttttttttttttaaaaaaaaacaaaaaacaaaggaaattaatggggggaaggggaaaaacggggaaaaaggggggaaaaaagggggaaaaaaaaggaaaaaaaaaaaaaacaaaaaatcgcgggggggaccaaagggggagggggggggaaaaaaaaaaaacggaaaaaaaaccaaaaccaaaaaaaccgggaaaaaaaaaaaaaaagcctccctctttcaaaaaaaaggggggggacggggcggggggaaaaaaaaacaaaaaaataaggggggcccgggaaatatcaaagggaaaaatcccacaacaaaacaaaccc

SEQ ID NO: 8427 - DNA, 450 bp, Homo sapiens
agctttttttttttttttttttttttttttttgtctttttttttttttttttttttttttttttttttttttttttttttaaatcaattaaagaattatgaaatttatttgggtacagggaataaccggggcaaaatggtgggaaaagttggtaaaacaagtttacattaaatttacttacaattacggtggggtacatttttggaaggggtgggtttttaaaaaaactggcttaaaatcccaaccttaaatattttggaaattaaatcattagcttttctttttttttattaaggaggggggcttgttcttgggtttatttaacttttacattaatggggcacttggttatcttatgggataattctttttctcatttaagcctccccacaaccttggaaagggattaccccatttttatggggggagaaacaggcttagaaggggaaa

SEQ ID NO: 8428 - DNA, 194 bp, Homo sapiens
ggcagaacgatctgcactctttgtttaggcatgttggcttgacaattaataactttcatctgacttttataaggaaacggacatgcttggaggctgaggatgcttaatggaatgataacaacacagacgtgggtatatttgatgtgacagtgattgacatattcagtctgtacgagatctgatgattgaatgag

SEQ ID NO: 8429 - DNA, 354 bp, Homo sapiens
  misc_feature (1)..(354): n = A, T, C or G
tctgactatggaaacatgaagatatttacgggtgtatgccactaagaggagaggaaagaaatattttttataggaacaataccataatcaaaaaaaaaaattgtttattgtgtataaaacacaagccacaacgaaatgacatgaaaaaatatttatgattangaaagggaatgttttgggtttataaacaaaagtggcattggtttactttgtaagtaacgaaggggttcatttggaatgcagcgataatgatggagtatggtttaccatatttttttaggtaaaaaaaaaatgctctggggcatataatggttatttttaacggggaaaggggggtagttattaattttttta

SEQ ID NO: 8430 - DNA, 226 bp, Homo sapiens
ttacatatgttgttagcataagacactggcgatgtaactgctctaaacaaaacaccgaaagttgtcctatgcaatatatattattatatacatatatatatttacataaaatactaaaaaagtgaaagccaataataacattggataaaagtaatacatatctgctaagtgacaatatcaaaaaaatcaaggaataattttacaataatataaataaaaagaatgt

SEQ ID NO: 8431 - DNA, 498 bp, Homo sapiens
ccccccccttttttttttttttttttttttttttttaaaaaaaaaaaaaaatcatgagaaatatttggggacagagaaaaacagggacaaaaagtggagaaaagaggtgaaaaaaaatttacataaaatatacaaaaaaatacgtgtggggacatatttgtaagggagggggttttaaaaaaaacgggtaaaaaaacaaaacttaaatattttgcaaaaaaaaaaattttctttttttttttttaaaaaaggggggggagtattttttgggttaaaataaatataaaataaaagtggaacttgagtattttatggaaaaattttctatttcttttatacctcacaccacccttgggaagggttatacccattttttgggggaaaaaacaggggtaaaagagggaagggggatattttgtgcgcgcaaacgctttatggggggaagatttggtaattgaacctataattggggcttctttttaaatataaaatattttg

SEQ ID NO: 8432 - DNA, 178 bp, Homo sapiens
gctcactgtagctacagcatagcagaccagtagagccagagaccctccattcaacacataatgggaaccttcctccttataaaggcggcaggcgccaccttcaagaagcgaaaaacctaacgcgacgcaaaagttatcacactaaacaggacaacctcccgactccactttgcccact

SEQ ID NO: 8433 - DNA, 306 bp, Homo sapiens
actgattgtggcaagcatgagctatattaggggacttgtcaaatagaggagtggaatgtggtaaaaatgatggaaaaagacaagtgcataaaaaggaaaatggcgtgtgtgtgtagaacaccagatacaatgaaacgtcatgcataaatatctatgcttagaaagcatacctcatggtcatatgaacaaaagaggcattggtgtaactttgagaagaacgcgggggctgatctggaacacgagaatcatgagggggacaggaaacccatcttgactatggggaatgaacatagctgagacggagcc

SEQ ID NO: 8434 - DNA, 194 bp, Homo sapiens
cggagtatggagaaatgaagctatgtatgtgattgatcccctaaaagaatggaaagttatctttagtatggaacaacacaattatatgagaaagaaaattgtagtctgtgtcttcaataccattatagatgtagagatgcgtatcaatagaatattgtatgcgttagaagagaaatacctacattggaccttat

SEQ ID NO: 8435 - DNA, 514 bp, Homo sapiens
gcacgattgtacatgcgtggcgccaatcaacaatatataacacgaccgaaaattattgttgcatgatgcatgtttgtgtggttgctcacactgcaaaggactgtataataggggatgaaacggtgctgcggtgacatgatgatggatcgtggtgatatgcatgattgacgagctgacactaaccatagaagatgtggtgatggattaatatgataagtcacagacaaagatgcaggacgtggtgcccgacaatgccagctatgacagcgcgctcatgacgtgtcatatcaagggtgatgacagtgatagccagagggatgctggatagcagatggaggcagggacaattggtgaataggagtggagagagcatagcagtaggagaactggagaagctgcggtgtgtctctgagtgcagctggaacttggacaagagattaggcgtgaggtgaacatcataccacctgcccccgccagacgtgacaatgataagccacaatgcgtatgctctcca

SEQ ID NO: 8436 - DNA, 322 bp, Homo sapiens
acaagcttttttttttttttttttttttttttttttggttttaaagtttaataatgaaaacacatggaataaagggggtaatccatgtattggaaacagcagaaaaaggaggaaaggggaccatccccataggggacactaatctttggggtaaactaaaataaataagggaaataacacttaatacaataataaagaaaaaaaaaaaaattacattaaaaaaaaaaacaggaacgggggaaaggagcccgggattgggaggaaaggcggtgcatggaaaagaactcaggttcaggggaccttcctggaaacattctggtgt

SEQ ID NO: 8437 - DNA, 354 bp, Homo sapiens
caagcttttttttttttttttttttttttttttgggtttaataataaaaacacttggaattaacggggtaatccaggtattggcaacagcaaaaaaaaaaggaaaggggaccatcccaaaaggggacacttatccttgggctaaattaatataaataagggaaataacacctaataaaataatacagcaaataaaaaaaattacattaaaaaaaaaaacaggaacggcggaaaggagtccggagtatgggggaaaggcgggtaagggaaaagcatccaggctcaggggaccttccctgaaaacttccgggttctgagcagctcaactcagtcccaggcataacacgtaccccgg

SEQ ID NO: 8438 - DNA, 258 bp, Homo sapiens
acctcaaactcagagtttcttcccttctttgattttctggaggacctgcagctggccttcctgagacaggctccattcctgttccatttgccttcccggcagccttccctttagtgggtataggttttgacgttctgagttactttgtatcaaagagctaattaaaaatggtccttcaaaaacataaagaaaaacagcttgaaaaatgtacctgcccgggcgggggggggaggggggggggagaaggggggggggggc

SEQ ID NO: 8439 - DNA, 290 bp, Homo sapiens
  misc_feature (1)..(290): n = A, T, C or G
tgtggtcaggcttatgaatatgctcangtttaatgagatgctctgttgtaatgtgataggctgtggaaacaacaatgagtggaatgacatcaatgatgccaatgaaattgagcatgtcaactagcgcatgaaaaatgggcatgatcatcaaagatggtgtgacggtccataagcgtgcgacgggccatacaaggactttgtgccggaagaacggcttggacatggggataggtaagcagatgggcatatgtgaggggaacggtatcttggctgctgacatcgcgatcgct

SEQ ID NO: 8440 - DNA, 434 bp, Homo sapiens
  misc_feature (1)..(434): n = A, C, T or G
ggtcggccngggtcaagcctgcgtatcagaatctgagacagcgtgttggcaactttgttgcaaatcacttggcaactcacacatggagtccgcatctcaataagaaccagctaagaaacaacattaaacaacaagtcctcaaatcaggaatgttggagtctggtattgaccgaattatttctcaggttgtggacccaaagatcaaccacacattcagacctcaagtagagaaagctgtgcatgagtttttggccacgctaaatcacaaagaagaaagaagtggcaacacagctcccgatgatgagaaaacagacacttcccttattacacaaggtgttcctactcctgggcccagtgctaatgtaaccaatgatgccatgtcgatattggaaaccataacttctcttaaccaagaaaacaaggctgctaaggct

SEQ ID NO: 8441 - DNA, 450 bp, Homo sapiens
gacgggctccacaaacaatcacggtgtggcacactcaaactcacctacgcagaacctaaagcggtgtgtgaatttgaacgcggacatatgtcatattagaatgaaatataggcattctgaaaaattgtatttctatgtgtagagatgaaggaaggatgggtataggcttagcttgatactgcaaatataaaccagggatggggtgtaggaattgtaaaaacaggtatgatctgattattgtaattcataacattaggagagagataacggactaatattgcttcaacagataaaccaaagaaagaaggagtgccataacatatactctgcacacaatgggacctacagcttattaaactgattttctttgtgctatatctgctaaatatttgttgataaatgtccacttgttggtctcccatactgtacgaatgaaacctcaatttacag

SEQ ID NO: 8442 - DNA, 210 bp, Homo sapiens
ggacgtgtacttgagaaaagaagagtaataatgaatataacttaatcaataaaaaaaacaaggtatttaaaaaaagaaaggaattaagagaaaatctgaatagatgtatgcaagtgtaagcttaataatgattagagtattatttggataactaaataataatgaatgaagcagagactgaataataaaataattaggagtagactaagg

SEQ ID NO: 8443 - DNA, 434 bp, Homo sapiens
  misc_feature (1)..(434): n = A, C, T or G
gtaccggcctgaagataaaatgaatgaaataatgaataggcatatcaaatgatatatagtaatatacgtgggagcaactagcaatgctgataaccttgaatgatgacaaaacaaaattggtaaaatagaagaataaattaccaatacaatatactagacattgttaaaccacaatggtatagtgaatgcaagaattatgagtgaaacacacagtgaatagagaagcgagatacgacatatgaaaagacagtgtaattctgatggtnggtaatggtgggtgggataagactctatgatcacatagctgacaaggcgataataaatgatcaaaaaacatatggttggagaccatgcgctggggactttttctgtaggatatgggagtggacaatctaggtcgccaccgcgctaatcactaatgtattcgcggccgc

SEQ ID NO: 8444 - DNA, 162 bp, Homo sapiens
acgtgtacttgaaaaaagaagattataaataagtataacttaattattaaaaaatacaagggattaaatgaaagagagtagaaaggaaaaattggaatagatgtagacaagattgatgttaataattgattagagtattatttgtatagaaaattataatga

SEQ ID NO: 8445 - DNA, 226 bp, Homo sapiens
gacgtgcacacctgaataaattgtatgctatactaacttgccaagattaccacaacattaaaaacatatgtatacattaatgttctggcagtggactatgagaaaaaaactgaaatgaatacagtgatgcatgtagaacatgtcatgtgcaaactggagtggatgttgaggacggagcaatgagaatctgaaaactcacagggatgaaaaaaataaacgatactta

SEQ ID NO: 8446 - DNA, 242 bp, Homo sapiens
gagtgcacaacaaaaaagaagtgtataaaaaaatattgcatgatttattaaaaataaaaaatattagaaaaaaaaaagaattaaataagaatttgataaaataaatacaagaatacttagacatatgataaaaatatgattgttctactacattctaattaagaaaggagattgagagataaataaagaattaagagtagtgaaagagtaatgagtaagagtatgaaatagggatgtaatga

SEQ ID NO: 8447 - DNA, 162 bp, Homo sapiens
  misc_feature (1)..(162): n = A, C, T or G
aagtaccaatgtgctgggaggacccaataattgatgcaggggtgtggggtgttacactgtgactaaaaaaaccacataacatcataactggaacatcactatgttgggatctgtatctacagatcacataaggaagggaagtcgtggaganaagcatggggt

SEQ ID NO: 8448 - DNA, 194 bp, Homo sapiens
caggttaaaaaaaaaaaaaaaaaaaaaaaaaaaaaaaaaaaaaaagcttgtacaagcttttttttttttttttttttttttcccagtattcataaaataaattttttagattggcctataaaaaaaaacatccaaccacctttccctaggaaccttttgaacaccataagaacaaaagctctaacatataccta

SEQ ID NO: 8449 - DNA, 513 bp, Homo sapiens
  misc_feature (1)..(513): n = A, C, T or G
gggtaccaaatacaccgacaaaagaaaaaaagcagatgggctgctaggtttctgcttttaaaaaatttcatataagaattgggtttcaagcaggaagccagaacttctgcctctggttcttaaattaacattcggtgtgtaatggacaataggcagggactcataatttgactaactcacatgctcaagcatgatcgtgtccaatttctacaggcctcctttgtaaagaaatgtgtaacaatggggggaaagtcataattctacctgaaaacatggattgtaagaagaaataaaaaaatcaaacagtatgttttaagtttcccttttgatactgtgtttcagggtaagtgacagcttctgcaaaccaagactcagtcctgattataaaggatttttaaaattacattattaaaaatatgtatttattcttctttcactttatctattttccaaagcctctttcaagtaaactgtgaagtgcctgagtacctgcccgggcgggngtggtgggtg

SEQ ID NO: 8450 - DNA, 638 bp, Homo sapiens
  misc_feature (1)..(638): n = A, C, T or G
actagaaaagcctggctgccatccatcgctgcctctgaggtggaggaagaggcgggtgatgtgctcacttctgatcaacatgtgttgcctcctctcagccaacttctatctcactgcactcactctggtcatgataaatgttcgtcacctttctgcttcattccttanggcctaaatcangaagctgttttatcgatggtttccttttgggtcagtaaccagctttggataatttcctctgattattcaagtcgtgggacaggtaaactacattcagcangaacttttctncgagagtgttatgtcatggaaaagacaccaaacacagcaagtattgtaatgaatacaccatcccaggggtcagtaagctctgcctgccaagaagacacagtgaggagggtccacagtcctgatgangtggcgtttggtaacttgtagaccctagcatggccaggtctggtcacccttaagaacttctcagagaaactaggaatcttcagtgaaagaactaatgttctcctcagctgaaattcccttgcttgtcagcatttctgcaaagctcacacttgtttcaccatacctcccttggatgtgacatgtangtangaagtatgtgcangtgggagtcatttgttagg

SEQ ID NO: 8451 - DNA, 162 bp, Homo sapiens
tacatgtcacaccaccgccatgttttgttgattgaatcggcttgggtatgcggcctccgctgactgcattggacattgatctcggggagacgtgaagaggatgtaagggtggctatgatcgctaatagcaccgagtgcctccttctgtgaggtgactgagac

SEQ ID NO: 8452 - DNA, 386 bp, Homo sapiens
gtgcatgctatcaatgtgtccaattcccacatcctgagctacgcactggaagacatgcctaagaaaatagacgaaatacaggtacttcttgatgacagacgaagcataagataacatatcatagtatagatgaagcaaatataacgactaaactaatcttacataacaatgcattacattatttgacacacatggtcatgatgtgattaagataagatagacaaatatgaagattaaatgacataatgggtgtgaaagaacgaagtgaattgatacacacactatggtaatatctgtatgatatacactaatactactgatcatacaactaaaacaaaaaacaaagaatatctagttcctgcttgtcaagcatgtgataactaatg

SEQ ID NO: 8453 - DNA, 162 bp, Homo sapiens
tgcgtcatgcttctcagtttcttctggtaactaatgaccaagatgaccaatacattgtcaacaatgccatgatataagataaggtagtagaatggattatttgatatttattttgtaaatgtgcatctttttcaactcaattttatatttctttatgatttt

SEQ ID NO: 8454 - DNA, 194 bp, Homo sapiens
ttacaacttataagaaaaagtaaagggaaacctcaacatgcatgcaactgccttgtgtgaccagtgtaagtaccccccacgagctatggaggataatttagccccggaagcgttatgcttttcattattcaactgttctccccagggtgttgcttggtcaaaattaaattatttccatccatagccaagatttg

SEQ ID NO: 8455 - DNA, 178 bp, Homo sapiens
tttgatttggttaagacttgatgatatggatggaacctcactcttaaatgcgtgatagacacacactctatgcaaactgggaagtttgacagaaagtctgggtagggaaacacacatacaggccttggtcatctggctagcagaactatcctgtgttgagacaaattgcccgtgcgct

SEQ ID NO: 8456 - DNA, 226 bp, Homo sapiens
gccgatgtacgaaggaagccaatactacatgaggtgtaataatgcatacctataactgcactcacctctatgtaattgctcacatgccgaccaaggtgacaattttcttcactgctgacacttctgagtgatgatatcaacgaatgaacacgctgccactctctgacaagacaactacgaatatcattatatataagaatagggaggggctctgcttactaaagac

SEQ ID NO: 8457 - DNA, 482 bp, Homo sapiens
gaggactgtgtaacatgtgtcactgggcaagctgtgcctataatactggtgatgctgtgagagtatgtgtttggtggacttgcagtggttgtgatttgtaagagttacttttattttttgtaacattttcttatgatcatgtctgtgttgggttgatagtgaaggatataatgacttgttggttgtattgtagatattgtgacatcagacgggatcacgctaatcacttttgtattttcgggcgggtgtaagtctagcatatgggagagctacataagcgttggattcatacgttgaactattctataatgtctgctattataggttggcgtgatgatggtcataagtggatactgtgtgaaattgttattggctcactattgtatactatataggaaccggaataattggtgtaaagattggggtgcctgatgagtgagttaaattgcattaattgcgttgtgctcactggctgctttcca

SEQ ID NO: 8458 - DNA, 226 bp, Homo sapiens
taggcatttctgacattttataaacctacatttaaggggaatttttaaaggaaatgttttttcttttttttgttttttgagggggcaaggagggaccagaaagttagctcttcttatgtggaatattatcataaaattaccttagtaaatgccatgtttataatctaatctttcaaagtattgaattgatgtctgcaatgcccatcctttcttcttaggaattgga

SEQ ID NO: 8459 - DNA, 162 bp, Homo sapiens
aggtgtcacatgtagagctagtcatattaatatacctgaatgttatgtattcatgctaattaatataatttgcaccaacaaaaacgtcaaacaacatatgtgtttgggaggtctttatgtaactctgtatataaaatacaatgcacgtttttcccgttgttt

SEQ ID NO: 8460 - DNA, 674 bp, Homo sapiens
  misc_feature (1)..(674): n = A, C, T or G
ccatgaagtctgtcttttgtcaaagttctatgcagtcccaggatagcgtgatagcagtggttaaacacaaccagctagttatagctttcattgtatggaaagacctctctggtctggaactctgcctttgaaattatccacgtagttcagaaggcaaatacttgttaaagggatcccaaaaggtaggagacaagtagtttttgttatgcattagggcagactttcaagcacaagacacaaaattgagcagcaaatgtttgggtagtcccatctcccttcggtttatatgtgggtagtaaaataaataaaattttccttctttgtctctttcttgaaataaaatatcaggtatccaaggagagctgaggattctcaatttgctagattgctttaaaggggtcagatttagaaaattaaggaataaatgaagaacaattttactggagtaggtgtggtcaatangccctttttcattttgtgccattgcttttagcacaaggatgtcaaaaatatcacatagaatgtcatctctgatggactgacagagacctcctgttgtgctgtgttaggacatgaggcttatcccagcttggcgggagagaatgctaagcatgatgagtgagatctgccacaggcacggatattttctgctcctcttctgtttgtttcaaaca

SEQ ID NO: 8461 - DNA, 338 bp, Homo sapiens
atcaccatcagggtaaatgacactcctgatgatgctgttaatagaaactgggttataacacctccccattacactcaagcacaatgtgtgtagttctctaataaggagatgaattgttcttttataccatgagagtgacatgcacggcacacacttggttaaggggtgtgcctgcatcaaaaataaaatacatagaatcagtgtaatgtgaacataaaataaagaataaatagcgtggctgtcacatgctatttccctttatggaaggtgagtgatatgtcgtgcatgctgcgttctgcacaactggcctactgggagggcactgttgctgcctggtt

SEQ ID NO: 8462 - DNA, 498 bp, Homo sapiens
gaagagcataccgatctaatagtagccagtcagggttgtccgagattgcaaatactagatctatatatcatatatctatcattatatatatgggagaatatattatgggaaatatatatcaaaaatctatatataataaagtatttagtagtaatgaatatggtgatatgaaaatatatatataatatattatgtatatatcatgatgactgatatactgagactgtcgtactctgacttatgatgcatggctatgtgagcacagggatgtgactacggggctatatatgcagggaaaataaggcagataacatgggtagtatgtctagggtagtgtgtgaatcacagaagatgaatcagtgaagagatattattgaattgatgctattcagataatgtgggtgtgaacagatgcatggcatcagaggcatgtctgatatggcatgaatgagtgaagtgaaacgtatgaagagatactgattaaagagaattcatgca

SEQ ID NO: 8463 - DNA, 290 bp, Homo sapiens
ggtaaagctatttggttcgattgttaatttagtttgctttagagagtagaacatataatgcgacaaaagattagtaatgagaaaatcagtatttcattggatgtgttaagtgtcaaaagtcactgtaatggtgttgtgttcaaccggttgtttgttttgaagaataatggtgtatgtgttacatcccattcttcatgtccaaattttggacgttccttgtctcactcagctgtgataaactggtctggagttgctgaccgaccattgttcatcgaatgaggcattatctg

SEQ ID NO: 8464 - DNA, 242 bp, Homo sapiens
ttgggtggtggaggaggtgtgggtggatggtggtgaagtgttgtgtggatatgtatggtttatagagtagatgagaatgggataaagattgtgaattatgaggatgtggagtagagtgagtataaggggtaagatgtatgaaatatataatgaatggattatgtgaggtgaaaatgatagatagggtatggtgtgaatggagaggatgtaatttataaaatgaatatggtgttttgattgta

SEQ ID NO: 8465 - DNA, 178 bp, Homo sapiens
gggccgaggtgcacatgtggaaagtaggtcatgagataaaaccatcaatatctaatatatatgaatcaagtgtgagttcacaactacaaacactaaaacacattattaaaaaagcttgtacgagcttttgctttttttttttttttgtttttcggatcacaacgcttactatacgttg

SEQ ID NO: 8466 - DNA, 402 bp, Homo sapiens
cgcgggggaggtacacttaaacactgtgagaataacagagaaagatgagggtttttatatacagtggccgctgtgtttgcggcacttgggaatgacatgtttgtttttacaccaccgtgagcgggacctggaagtagagggtgcgctgcacaaggcccaaagagaatatcattacttgctgatggtgggtcacgtgcgccgggcacacggctgtggcggagctagcgctggccgcttgccagcttcacgcatgggctccctactcctgacgcctatatgcatactgttgtgtgttgcaactgtgtctaccatacaatgctcggagggatgctgggaatgacgtggtgtggggagacatggctatgacggttgaagattgacccatctttccagggtggagcg

SEQ ID NO: 8467 - DNA, 210 bp, Homo sapiens
ttaccgatgcggccgcgccgggcgatgcacgtgatcaatcttgtactgaggccacagggttgcaccagaaattctgcttctaacacttatgtctgagtcctgtcctggagagggctgactgcacaatgattatcttttcttttacatgtggcacgtacgtgcagcatcagcaaggtggaggggggctcgcgctccacacgcccccaacaa

SEQ ID NO: 8468 - DNA, 674 bp, Homo sapiens
cggggccgacgtgcatgataaaaatttgtggaaaacatgggtcctgtatacgggggcggatcaactcctgacacgtaattcttaggatcaatatgttgggctgtgctgaggctgacaggtgatcttggggtggtccttttatggctcgtggagggtcttcatggttaggcttgcattataccatcagatcatagaagcggacacattgactcatatcctatggctagtaaataagatgtactggatagtgaatctctttggttacgcatgacgaataactggaaagaggagagtgacataaatataatgcagagccatattgtctacttgtactgcaaacttttgatgatctgtatagatgaccagagcatccaactgagtgaggagcatcatcgcggaagacatgattgtcatgtcatacgatagcagcggagcatataaagaggatattggcatgctctgcgccgagtccaggctactgactaccgtatgtgatgccgactgcaggtgcgatatgatggagagctcagctcgcgtgggatgggtaacgttcggttctatagtgtcacgtaaatagcttggcgtgatgatggtcatagctgtgttgtgtgtgagtggttatgcgctcacaaaccacacacatacgagccggagcataagtgaaaagccggggt

SEQ ID NO: 8469 - DNA, 226 bp, Homo sapiens
cgcggccgaggtaccggtgaggaaagtgcggattgacacttggatggttgtaagtatgaatcacctgatgaggtcacaaatacaatgcaatcgtcaaactatttatagcagcctctaacttgcttcatatgcttctgtttacagagtgaatacgacccatctgctgcagtgaatgtgattgagctctcaaggtctgggcaagaggggattggtgtaagtgtatcca

SEQ ID NO: 8470 - DNA, 162 bp, Homo sapiens
gggcggacgggcctgacggggaggaggtttttgggtgtgatgaagattgtggcgtgtttgcggcattggacagcctagaagctcaggacaagtgatgactctgtattggaaagtgatgacgcaaggccgggggacgcaggggcagccaacacatcagccatc

SEQ ID NO: 8471 - DNA, 226 bp, Homo sapiens
  misc_feature (1)..(226): n = A, C, T or G
nccgnctccgggtctagnttactgggacaacctgntgntggncaggnatatggcactcaccgggctgggntaaggcacagncctgggntaactcactgggcattgggcaggctatccggcatgggctatggcacagcattcctacctggccatgacctgtgcatgctaggcacagctatttgcgtggccctccgctctgctctgtgctatggccgcgcatagcgca

SEQ ID NO: 8472 - DNA, 338 bp, Homo sapiens
  misc_feature (1)..(338): n = A, C, T or G
gaaggantagcaggnaccgagaggataccagcattactgacgaacanggaccagccccacctgggaccctcttaccccacaactctcattgggctacaccactcagtcgaccgatacacactcgacacagggacgntagggatgcaatgatcagacctcctggtagtcacctaagcactatctgggactggtttggggtaggacaaaggcagcacatcttggcaactggcacaagggcctctccaagctgtaagggcagctcaacagcacctactgggatgggtcagcgcaggggctgctggtcctaggtactctggcccggggcggaacgacttact

SEQ ID NO: 8473 - DNA, 224 bp, Homo sapiens
  misc_feature (1)..(224): n = A, C, T or G
ncagntacgncctggcgnaaggntcctttctggacgntcaaggagnatgnaatctggnaaaaactgtctattctcttagnagnagnaaaatataccccacctaaagtcgcagctaccattaacaaaaaaaaaaattagcaaagggaaagaatcaatggtaaggacagtaaatatactctgagaatagagtaagtacctcggccgcgaccacgctaatcactagt

SEQ ID NO: 8474 - DNA, 770 bp, Homo sapiens
  misc_feature (1)..(770): n = A, C, T or G
gggncagntactagnaaaggnccggnctgccatccatcgctgcctcgnaggtgganaagnagcgggtgatgtgctcacttctgatcaacatgtgttgcctcctctcagccaacttctagctcactgcactcactctggtcatgataaatgttcgtcacctttctgcttcattccttagggcctaaatcaggaagctgttttatcgatggtttccttttgggtcagtaaccagctttggataatttcctctgattattcaagtcgtgggacaggtaaactacattcagcaggaacttttctcgaggagtgttatgtcatggaaaagacaccaaacacagcaagtattttaatgaatacaccatcccagggggtcagtaagctctgcctgccaagaagacacagtgagaggggtccacagtcctgatgaggtggcgtttggtaacttgtagaccctagcatggccaggtctggtcacccttaagaacttctcagagaaactaggaatcttcagtgaaagaactaatgttctcctcagctgaaattcccttgcttgtcagcatttctgcagagctcacacttgtttcaccatacctcccttggatgtgacatgtangtangaagtatgtgcangtgggagtcatctgtcagcctgctatgtttcagagatcctgaaagtggtttgaaacaaacaggagaggagcaggaaatatccgtgcctgtggcagatctcactcatcatgcttagcattctctcccgccaagctgggata

SEQ ID NO: 8475 - DNA, 226 bp, Homo sapiens
  misc_feature (1)..(226): n = A, C, T or G
acagntacgatttacagatcacggtctcaactgattttggcatcacaatataacataatttaaagtggggtgatttattcaacagtatcttgtttcgcaaactttggagacatgtcctagactgtaccttcaaactgtattcctgatcttgctggaacatgttggttgctggcggtgctggcatgcagccatggtgcattcctggtgcctgaactgatagatgtgg

SEQ ID NO: 8476 - DNA, 338 bp, Homo sapiens
  misc_feature (1)..(338): n = A, C, T or G
gnagatacgcaagnttcttttactttcactgnaagnttctgggcgcctctggtgnttttttcctntcttttctggaaccaggggcaagcactccggtctcttggcttctgcgnacggggcagnatctgagcaatgcacttgcgactattctgctcctctcctgcacaggggtaagtatcgtctctctagggtgaaggcagatctggcatttgtcgtcttcttgggactaccagaccgcgtccctttttttctctgctgcgtttcttttctcttccttatcctcttttaatctctgtccctcatacttgcttatttcatacgatgctaggttcactcct

SEQ ID NO: 8477 - DNA, 322 bp, Homo sapiens
  misc_feature (1)..(322): n = A, C, T or G
cagctgnaagctccaagncaaancaatacagnaactcatccagtgatggctgaactgtcgtcatcagctaaaacaggtaagcgaaaaagagtcagatgctgtttcgaggtttagtatatcctagtaatggttgtcctgcctgcaatatttgaattttaaatataaatctatttattaatatttaacattatttatatggggaatatattttttgactcatcaatcaaataagtatttattatagtaatcttttgtgtaatgaatatgaatatttattaatatatggattatttattatttttatatcttgtgattgttttat

SEQ ID NO: 8478 - DNA, 498 bp, Homo sapiens
cgggtacatatatcaaaggactataatataaacatgcacctatggtattatatagcaaaaagaatctatggggaacagttacttatgcacacattaacatactccctgaattttgattaacacgatgttctcatatgcatgtgatattcatctacttatttttggctggtcatagtatctgctgcatgttatcagagtttatattatcacctcgggagatacccacctaatcactggtgtattgctggcgcggtgtgagtagatcgtctgggagagctcccatcgcgttgacatgcctcggtcgtagtattctataatgtcacatgattagctggacgttctcatggatatagatgttatcctgtgtgcatatgttattagatctcaattccactcacactactatcggtatgctataatgcgtattggatgggggagttaatgagtgtatctcactatacattaattgtgttgcgctaactgactgatttacattca

SEQ ID NO: 8479 - DNA, 530 bp, Homo sapiens
  misc_feature (1)..(530): n = A, C, T or G
gncagatactgattacaacaatgccatgctctcgcagcagactcacgattcaaggtcttacatgcccgcaacatgactcacagnaactaaaacatctacactgtctaaaataagaactcaaatgtctggatgtagagactatattgagctggaaagtcaataaatctttcactataaccaccacatggcacattaatgcatcacatatcaagcgtatatagtgcctgagaactgaagaggatctgtaaacaactttcatgtgtgtaatatgactgatgtagacacgctatgcattgaagtactatctgaacagatggattacctcttgtcctagcatcatctcgactctgtcttgattatcaactgcttcccactggaaacatatgaagccgtctatttatttatgtgtgtatatgctatatgaattgttgactgtgtggaatgcttgctattgtggctattattctgaatcttaatactataaatatggatctgatatgattctgcttgtcagtctctagtgctatgca

SEQ ID NO: 8480 - DNA, 178 bp, Homo sapiens
cggccccgcccgggcatggttacataggcaccgagactgcggagtgggactctactaagtgtgtgtgcaactacatgtgcgaacgtggttttttttttacttcgtgcttgtttgacgctatggctgggagcgcatgagcacagagccatgaccgcgtgcacgccgtattcgatggcgc

SEQ ID NO: 8481 - DNA, 210 bp, Homo sapiens
cgtagtttaatatttattgtctctcttttctgctgttgtagtaccatattatatataagtaaagagatgcgttcaagatctagatcacgttctatgaggtagaggactcccttatcttgtatattcaggcggtcaagtagctatatctgagacggtcggtctatattgtatagtctatgaagtcgtgtgatgattctcaatagctctatg

SEQ ID NO: 8482 - DNA, 546 bp, Homo sapiens
  misc_feature (1)..(546): n = A, C, T or G
tggcatatgctgtattttattgtatcgtgtaagtgctagaaatatacccaatactgaaatcttattaactttgttttctatgcggcttggggttttggttgttcatgcattattgtccactattatcatttttctttaacaagatataacattgtatggtatattgtacatatattgtatgcatccattactggtgtgtgtttactactttggctgttgtgcttaacgacacatggaactgtgcaatatcgcttttatgcacaactctcggcttatttaaccaagaatattatcgtgaaacatcgtgtactggctaataaggcatattctcgtattctttgtaatgtgatatagtgatttcagatagctttaaagtgtatgtgtgacattcgtgacaactatccaacacatacttaactgtgccaatatttgtcaatttttatatctgatgcatgcgttcctaaaaaatgagatgtctctgactaacataacaggagtgtcaatttgtggtgcgtggagtgcaatgtagtagtgtcgnactcagcg

SEQ ID NO: 8483 - DNA, 338 bp, Homo sapiens
acgaggattagaaaatcactgaagtgactgttgatgacgtaggtgaagagtgggaagtagaggaggtgtggagattattatttaagtattttatgaatgctaagtaataggaagtggttgatggtgatatttaaattttgattttgttaaatttgtagtagaatattgattaatgattattttatgtggtgatattgtgatgtgctttatgttgagcaaattggatattatttattagtttgtttttgaagtgtcttactatgtgagatgagaggtatagtattgtgttgtgtgtttgttgttcatattgttgtgtattggatttagttttctttgaa

SEQ ID NO: 8484 - DNA, 177 bp, Homo sapiens
gatgcctgtgctcactgtccacgagtgcactgaggcacaagggcatgaatggatcctataaatgactcactttgcctggctcttggcactggatgtagctgttggggcttgacaatttagaacttgaagccctcacccattatccggaatattgtgatcctgactactattccagaa

SEQ ID NO: 8485 - DNA, 306 bp, Homo sapiens
aagatgtgatgaagcagaacgatgaattaatagatggaagacatataacatgcgataaaagtgatacgtgtcactatataaagagtaaagcccatacaagtatccatgctttctaatctcaacgttgtaagtggctgggcaacctatgcgacgtcttacacaaggacacaaagacatgagcatgagctataagggggctccaggactacctctaagagggataggcctctagtaactccaggctctgctccgaatgctgagaggagacttaaatactgttactgcggcccgttacatcagaactca

SEQ ID NO: 8486 - DNA, 162 bp, Homo sapiens
tcatgaatctccaaccttaaatactgaaacactgacatatgaagctatttgatgcctgcttgaatcaatatatcaccactacttgcggcactgatgacactatgcaaagttgcgtgatacgtccgaaacaatgccgtagggggggctacagggcacgaaaca

SEQ ID NO: 8487 - DNA, 162 bp, Homo sapiens
  misc_feature (1)..(162): n = A, C, T or G
tttttttttgntggtttaaaattttaataaaggggggncaaaggntgnaatggntcnaaaantcctcaagntccgnacggnactccccgnagaccaagncanttgnantccattcattattcgntctggnatcttagncaaagccccggncccctggnanca

SEQ ID NO: 8488 - DNA, 194 bp, Homo sapiens
  misc_feature (1)..(194): n = A, C, T or G
tttttttttttttttttttttttttttctaattactaccttttattctaagggaaaccagggcccgaaagncgaataacaagctggncgaaacaaaggaaactaggggtggncaaaaagaattaggggggaaaaacatggnctcttcctgggggagggagncggggaaaaggnaaaagaggtgctcagccggca

SEQ ID NO: 8489 - DNA, 210 bp, Homo sapiens
  misc_feature (1)..(210): n = A, C, T or G
tttttttttttttttttttttttatttaaaaaaatttcaataaaacggccgggcgggctcggggcggcccctatcggctcagccgggggnccctcctcccccaccccattctaccaggggagattctgggggggaggccaagttcccttctagagggggcttcacccttttcccagaaacgttccagtttcaggagnaggnagcaggcag

SEQ ID NO: 8490 - DNA, 226 bp, Homo sapiens
  misc_feature (1)..(226): n = A, C, T or G
ttttttttttttccacggntacaaaatctttaggtaantataaaataaataatagnaatattaattaataacaacaacacaacagggncaacaatattaataataacaaaanctctcccatggncccacgnccttcctccancttttctcttcggcttcacacaacttgngnanatanctgttttcatancgggnaaaacggagncccananagntcgncacactg

SEQ ID NO: 8491 - DNA, 338 bp, Homo sapiens
ccaggccaggacacacagacaccacgcacacgggaagcacggacgtgcagaccgcacctccccctctctggacccactctccccagctcgccagctcaagccaggagcacacagcgcgaccccagcccaccaccaagaggacaggacaccgagatgtggaggcggccaccgggcagacaaccgaggcgacaaaccacagaaccggctccacacgtagaagacagcacacaaacgcagccgatcccacaacagcacgcagtaccctccagccgagccacacaagctccacccgcccccccagctccacctgccgcggccccccaagactgccagccacc

SEQ ID NO: 8492 - DNA, 594 bp, Homo sapiens
  misc_feature (1)..(594): n = A, C, T or G
caactctgaatatactaaaagctgttgaattacacactttaaataagtgaattttacggtaagcaaattatatcttaagacattaaaaataataacaaaggacggaactcacacatcttctttagacagaaatgtagtctcactgcagcaagtatggcttaaacctgcttctgaaccgtgcacagttgtaggcctgtctcaagtgttccgtcgttgacttgtgtcccgcctcgccgggcaatgatgtatgtgtggagcgcagtcatgttctttgttacgcaacacagttttcaccttgggctaagatgatgtgattcttccaaggtttgtggcagaaatcccatttaatanactggtccagatttcttcatgccgtaaaattgtttaaggaagttatttattctgccaagctctcgtcatggtgtccgacactcccttctgtctcctggagggccaggcttccgtgctctggggctcagcaggacggggaggacgtatncctagacacctgcatcagtcaaggtcatggatattgggaagacagacagcagcagacccaggtctgagcttacaaggtagccactgagtctgggg

SEQ ID NO: 8493 - DNA, 434 bp, Homo sapiens
ccatttgctcactggggctacagacgcttttctacctgcaatgtagatagactggatgccactcgtccttataattgttaactttttactgttatctttaacttgtgtttaacctcactttcatacactttagaagcaactggaatgataatggttattgtgaacaaggggcaaatctgcatgtgtgcagaatataatcgagttatctttcttttactgatactgaccccacatgtgtttgacctttctatgcacactgttgcctttagaatactaactgataaatcattttactgttgcttttctctcacatgttagcttaacgctgaacggcattttgactacagtgtgttctgcatatagaacattgattacacatgatatattggtttatactttttgttgtctcttgcttatttagtttgctgctcacg

SEQ ID NO: 8494 - DNA, 386 bp, Homo sapiens
gtactctctattacatcacccatgctaatattgatgatgtatcatctctatgtaggaatcgacttgtatcacctgcattactgagtgacgcatatgagatgagatgactgctgacctgttcttgtggcaccctggacccactaaagaacgcccttagtgatgaccaactgccacatgttacacattcttgatggttggctgtgtggcggaccttctcttgtgaccatgatccagaagctcctccaacactgcttcactggaacactgctgcctcagacgataccacgtgatgaagttgtggcttatggggcagctgcacgtccgagatttttgacagctcacaactctgagaatgcatagcttgagttgcctatggaggcagctaa

SEQ ID NO: 8495 - DNA, 642 bp, Homo sapiens
ggttcaagaacctgctggtttctggatgcgtaagtcacacagcctctgctgtgtgacactattcttgcttctgcctgtcatctgtgatcatatgccaggctcgtgccagaatccctttcttatactgatgtggcgtgatggatccgcatggggctgctctcctggaccttcgtgctgtccttatacctggtttggggagcacggtgtggatgacgtgagcgtgtgatgaactgcatggagattctgcggcaatagtgacacatgtggctggtgtgcttgagatatgggatgagatatgacatgcggaactaatagcatatgctttgtcatcacgatggcaaaatcactgagagaacagagaaaaaaacatagtactgtgtcgtgatcaatctaatccatgccgtatacgtggtcgacggacaggctacaatatggatcagcacactatgagtctgatgatacggtagagcatgcaatgatgatgacgtgatgggactcggcgtagtcatggctatagctgtttcctgtgcgcagttgccttccgctcacaattatacaaaacatacgagcaggaggcataaagagtaaagcctggggtgcctaaggagtgagctaactgacattattatgggttgtgcctgc

SEQ ID NO: 8496 - DNA, 530 bp, Homo sapiens
attggtggtagctcatacatagatacttggtcatatctgactcactgcttggacttctgctatatcactgcataacatggcggtgggtggttggtgtgatgtatctcattataggagttgtgtgaaactcattacgaatggaatggatatcctgatagtaacaacatataccatcacagaccgcttattgaaagcagtactatatattaccaaacttggccttgttgtctgggatgatctggacgacatgtgggtgatagaattggttgagaacatggacaagatattcaacgtgacatataacatgataccataacaaccctacaggaacatagctttcgactgatacaggtgtgactctgactggctaggatgctctgacacactgtacgtctacatacaaccaggtgattctagtttacacaataatggactgagatgatactaactgtggatgatagcactgtatgattaaaatgatctcttaggatatttaaaatagaagatataataaaaatatataaaagctt

SEQ ID NO: 8497 - DNA, 162 bp, Homo sapiens
tcgacgtatactatgatcttcttatctgtctttcgtgtattaggtagtaaccttatgtatatgtctctgctagtcattactgctctttatacattgatatagtctgtcgctggcagggatgtaaggggctctaatgggcatgtatctagctgatgctctgac

SEQ ID NO: 8498 - DNA, 162 bp, Homo sapiens
ccaaaagactgctggagaccactcaaggcaagacatgaatgtcaagtttctcaatagcaactaaaaagaaaacgaggactgactctcgaaacagctgactaatcattcggtatactgacttgaatgcccaacgcaaagcaatacatgaaaccacccaagcga

SEQ ID NO: 8499 - DNA, 354 bp, Homo sapiens
agtctgactattaaatgaatggaaatgacacccaacatatacagtatttatatgagattctgactgtctacatggatatcatgcgcggctgggtaaaaaatatccgtggatttgcacacctgcacaaagcacaccaagaactgctttttgaatcatctctcttataactggttgcacttccatgatcatacacgtggctagcgagtggtaggttaactcatatattgcaatggggtggtcttactcatgttgtggtgcataactggattagaggaatggacctgatgaatctgttgattatggcgcaacttgccaaacatgaatcttgactggtacacgactctgatgaagtgc

SEQ ID NO: 8500 - DNA, 466 bp, Homo sapiens
ggtacacatagggcactgaacatcttacttctcgtgaggattactgagctcgctgcatgtgattcgtgtgctcacactccactgtttaatatgttactatgacacacctactaaaagtatgacagctcctcttgacctggaagtgtgcaattaccatcacacgtggataatgcaaggcgctgctctcatttcctgttacttatgactgtgacgtgaagtgagattatgcactattaacaaatcatgatggtggagatgaaagtgctcatcattacatacaatgtgattgatacacagatgtgtgacggattgctgggataaaaatatatgtaagattaggactcctaaccgctggtttactcaatcataaacagaacaatgatcaaaacagaggtcacaatactgcctgaggtggctggcatctctacgacgcacgagtgcactgtacaccatgcctgcaaacgga

SEQ ID NO: 8501 - DNA, 178 bp, Homo sapiens
  misc_feature (1)..(178): n = A, C, T or G
ccngggtacatcccattgatgtcacttcgcaagagtgggcatgaccatattgtgaatctatgagtacggactattgaggactaaactggaaggatgcaactacacacactgtgaggaatggctgcgtctcacactagtatgctttattacagggactggacactggatagaanataca

SEQ ID NO: 8502 - DNA, 594 bp, Homo sapiens
  misc_feature (1)..(594): n = A, C, T and G
cgaggtacaggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttgaaatctggaccagtttattaaatgggatttctgccacaaaccttggaagaatcacatcatcttagcccaagggtgaaaactgtgttgcgtaacaaagaacatgactgcgctccacacatacatcattgcccggcgaggcgggacacaagtcaacgacggaacacttgagacaggcctacaactgtgcacggttcagaagcangtttaagccatacttgctgcagtgagactacatttctgtctaaagaagatgtgagtcctaagcagacttaaagccaagaaaataagaagaggaaagagagaggcctgccctaacccactgttgtgctgacttggacaattccaagtccaagaggactgtctactttcgaccttgtgtgattataacct

SEQ ID NO: 8503 - DNA, 178 bp, Homo sapiens
aggtaaatatcattgatgtgagtttcatactacagcatggatgtggtagtgctgcagactggtgctgcttatggggcagatacactagctctgatgtcaatgactggaacagtgtgattggatgcctgatggatgatttcttagacatgctaaagtgtaagtcagaccctgactcagt

SEQ ID NO: 8504 - DNA, 258 bp, Homo sapiens
ggggcaggtaacacctccagacctctttctgtctgagtgtatctagtttgctgcttttatttatgtattatgttctcctcatgtacttgctccttgctgctgggagaattctgtcgttctctttggccgatctcaaatcgtagaaccctaaactacttcctgcagtaactgccctggcttggcgtctcacaaggcaatactctcctcgttccagcgaggaccagagggtagcccagcctcccagtgtagctggactcc

SEQ ID NO: 8505 - DNA, 210 bp, Homo sapiens
aggtactggacctaacctaatgtagcacatggggacacatcgatattacaacaaagtctattagacgaccacgaaatacataagcacatataatgctgattgtaaatagatatccaaagcacctctgctacaaactacctggctcgtgtctgctgtatcttgccatccacatgatagggcatgtaacacgaactccagagcaatctcctc

SEQ ID NO: 8506 - DNA, 321 bp, Homo sapiens
gtacttgtgtgtctacagtcacggttgactatcccactatgtttactataaatgaggctctgtgattcactgcatggcagcaggtgatggcattgacataggccactgcttgatatgattttgtgcatcctgtccagaggtcctggactttatgagaggtatgtttaggcatttggttgacatgctatctgtctacccgtgtccttacgtctgggatcacatattccttctgtgggtacaaattgtgtgtgatttctgatgatagggggtggtgtataactatttatcttaacactggttgtatatattacattggtttaa

SEQ ID NO: 8507 - DNA, 290 bp, Homo sapiens
  misc_feature (1)..(290): n = A, C, T and G
cgggcaggtacactcangaatgtgctgcacaaactctattcagttagcagtgatcaccccgtgacccacacacaccttcgatataatcctacaaagtcttaacattaattaacataattaaataagtatttgcatctataaaaaatatacagaagaactaattgtggagtaatctgtgcctccatttcaatgtctgcttgtttcactgacattatcaatatattcttttcatacaaagtcttataaaaagcgaaggagggctgagcggatacgaccagccacacacaaaa

SEQ ID NO: 8508 - DNA, 371 bp, Homo sapiens
  misc_feature (1)..(371): n = A, C, T or G
cagntacaancttttttttttttttttttttttttttggtttggaacctttaataaaaataaaaaaggaatgcaaaaagaacacaatgttgaaaacttaatattaatgtgaacctcactagatgttcaaatctggtagagtgcaaattttgttcatactattttacatttttacaaactcaaatcactttggttcatatattttctataaactattggcaaaaaaatcctcaaatttacattcttttggctacattatttctaacagatatagatttacttccggtttcggagagaaagacttattgtgtgtgcgtgatcaagtctgttttaaagattcacacctcggccgcgaccacgctaatcactagt

SEQ ID NO: 8509 - DNA, 194 bp, Homo sapiens
  misc_feature (1)..(194): n = A, C, T or G
ttactaatttacttagcaaactttatcctgagatttgcaaatttaaaaaaatgaagaatcaaactatattttcttttctgtttttttgaaacagagtctccactctgtcatccaggctggagtacctgcccgggcggggtgttgtngtggttatgaatttgtgtgggtgtgaagtagagattagagataggatg

SEQ ID NO: 8510 - DNA, 162 bp, Homo sapiens
tttctgtgtaataagagtgactgcttataaggagcgtggattgcgatagagtattgtgaataaggttgtttctacttaagtagatttgtgtataggcaagagtgatgtatctttgttatagtttaggtgtatgtagttattgataatagtgcagcgttttta

SEQ ID NO: 8511 - DNA, 274 bp, Homo sapiens
  misc_feature (1)..(274): n = A, C, T or G
agcaaaacccacccaagcaacaactggggccaagaacggggnaacccaaataggcattaccccagaggaaccgaattaaggaaaatggaattaagggggtggcccaggattttgacgaccaatttgatgatgaaggaccccttccttgccttagggactggcaaacttttttaccatttggaaggtaaaattgaaggaccaatttcggtagtggaaggaaaacattggtttgtattaaaggaaaacaaaggcaatggttgacccgctttcgggg

SEQ ID NO: 8512 - DNA, 162 bp, Homo sapiens
cttgatgattgtactgtatgtgtccgtagagctgatggctgctgtgttctatggacgttggtggacgactgtctgtagatgaggaggagatgaacagtgtggggcaggtttggaacatcttgatgaatctttgcacgctcatgtattgaaatcttagcatca

SEQ ID NO: 8513 - DNA, 338 bp, Homo sapiens
tgtataatggccctggaccatcttccatgctggataggacttataagtgtgtaatacacacgtactatgggcaagatggataaagactactgcctacataacttgtatctatatccatcacatcaaccaatgataagtacgaatctatcctaattttacaaacatggacacataacaacaaagatgtcaatgtcctcattcaacagaactgaagatagatcaaacgctaaaccagactctgtctctattccctcctgttgtgccacggtgcatctctgccgagacggtgcctttatttagttacaaaacacacttgatgtatggcctacgcgtttaac

SEQ ID NO: 8514 - DNA, 322 bp, Homo sapiens
  misc_feature (1)..(322): n = A, C, T or G
ctggtccaacagctgagggatgttgagggaatactgtactgccactcaccgaattaacgcctgcaactatcagagatgaacaacataaaaaaaaacaagaagagaaaaaaacatagttagagaacctctgcatgaatcatgataagcacatatagaagaaaaaagatataaacgtggtagcgtcaatccgagagacgacatcgccatgcggtattgccagcaaacacatatggactggacagcnagacatggatcataatgatgaatgatcatgcgctactagactactgatcaatgggtggacatagcagcanacactcac

SEQ ID NO: 8515 - DNA, 786 bp, Homo sapiens
  misc_feature (1)..(786): n = A, C, T or G
ttttttttttttttttttttttttttttagtttaaagactatttcagttttagtcagactacttcagacctcagactccagacttcagactccagactttagacaacagactccacatgccacacaacagactttcagactccagcttcagactccagactccagatcgcacacttcagacaacagactctagacaacacactccagtctccacattccacacgacagactacagactccacactccagacaacagactccacactccagacaagagactccacaatccagacaagagactccacactccagacaagagactccacactccagacaacaggagacttttagactccagatcagacttcgaacttcagattcactccagacttcagactccagaccagacttcagactccagacccagatttcagattttagacttcagactccagaccagatttcatatttcagactccagaccagacttctgacttcagacttcagactcctgacccctggcaacatgcacatggcangcccttcacttagctggtagaaggaacacaggcttgggaaggagatgtctgatgttcactccctgacgacactcttacttgcttcaatgatctctctgagccttgggtggcccatctgctaaacaaggatgagttatttgctggggatgctaggagacttctgcctcatgcctgcagtgctgctcatgttgcccccttggaattacttgttcaacttctttctttcccactagacggggactttttt

SEQ ID NO: 8516 - DNA, 338 bp, Homo sapiens
cgagtactcttagtagcgcacgtctttgttgtatgcctttgatgggggctgctgaacgtctttttcaaggatcatggatgtctcatggaggaattaaatctcatgggtattgattcattgcttcacggggctgaagaataatctgtgggtgatgtcctgattgatgctgatatgacacatctttgaggtaagaacttgtttatgtccttgaactggatgggattgttctttgtgacctcatgagtatatacatgatgattcagctgtagacatgtgtgacatctcttatggttaacatggaggtggacattatacctgatggggcgaacagctacttt

SEQ ID NO: 8517 - DNA, 274 bp, Homo sapiens
tgaggacttgatagcatgtgtgtgtggactgaaatgcttatctcttccggagatgtgacgaaacgcctggtgtgtgtttgtgtttgggctgagactgtatagagctggtagtttgtagcatgtgagagattggagtgagtctgtgtggcttaactcctttctcgttcgtctgcgcataccggcatttagtctcgtgggttgattatggaacttgcatgtgaggctggatattgatgagctgtgtgtagtgcggctgatgcttaatatagagtct

SEQ ID NO: 8518 - DNA, 610 bp, Homo sapiens
gaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggagtggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgaacatcagatgggacctttcagccaatttctataattattgaacagcttttcgtggggccagcacaaagtctttaactgctcatagtagttaagaaaagatggggatacatttc

SEQ ID NO: 8519 - DNA, 162 bp, Homo sapiens
taccaacaactcttggtaaagatcacctccgcatgcacagagtgcttgacatgtgctggatatcacgcttgtcgctatacgaagggatgtgattactgtctgtaacgacccttactcgttgtgtcaataattgactcatctagacgtggataggctgattca

SEQ ID NO: 8520 - DNA, 466 bp, Homo sapiens
  misc_feature (1)..(466): n = A, C, T or G
gtacttgataagttgattctaaaatacatatgaaagtataaaggaacaagaatagccaaaaacttttgcagaaaaacaaattangaagacttgctttaccaaatatcgagatatgtgtttataggtaattcactgagctgacattaatgtgttgtgtatttttttggtcagagttgatccttactngagagtgggtatgcatgagtgtgtgtatgtgagagtgagtgtgtgtgtgtgtgtgtaaaatggaggagaggactaaaagtgtgactagaagcagctggaagtagcanngagagtggaagttagtcccctcgagtgtttgcaaagtaagacatgcctgcccagcactcttcctagtgtatagtggctacaaatagagtagagaacagactccagtcctcaaagactttcagtcttgcgagtcaactcagactcaaatgtagaactgggaaggacagtgccg

SEQ ID NO: 8521 - DNA, 210 bp, Homo sapiens
atgcacagtgcacatatctggtacaagctaaatctggggcgcatcacagccaatggtaaattctacagtcccttctcttacggatcataatgccttgattgtaagcgctgcacatacctcagggtcgccatctactgtagataaaaaacaactgtggatgactataacgccatgtgcagtctcatggggtagaggcttcactcgtttaac

SEQ ID NO: 8522 - DNA, 514 bp, Homo sapiens
tgcacattagtacatttttcttaatggtgtaatacttgcgtgtagctgaaccaatcatggatactaccatatcataaaagaacatgactatatctccgtctatcatccattaaactattacctttcacagctaaggccttgacctatgcctgaatgatgctgttacataagctgagataatacagccatttctgtgtcatccatcaggataaacagtatccacgttctacgagctgtgtagcgtgcaaccaatgccaggagtacatactgtatgctgtggtcggagcttctgctaaccactctatcatgtggaagatggataatagcttatgggggaagccagacaagattgataaaaccactataggtgcattgacatgtctagctatgtggtgaggaatgtgactatacatcgtgtgatgatagttgggaagtatgcgctcaatataggccatctgctggtctgacagaatctcagacgtgaccacgctacgtaccagccacggccggccgg

SEQ ID NO: 8523 - DNA, 322 bp, Homo sapiens
acttgatacaggctctgacaccagatgacctgtagagtggccacagaaggtgggcaacacactaatagggtacggtggaaaaacatatggcggagagagtgacatgatgatgatttcatttaggaagatgactacaaatctatcataattgtacaatgtacgtactcctagcatatcgcgtatatgaccgtcgatcatttcaacagaaatgaaagcatggatgtcacgctacactgagcgtaatgtatcggatgcgctggctgtttgtgcgcgctgctgcagtcgtgtgcacgtagcggtgtgcgctctgacttgacgtaac

SEQ ID NO: 8524 - DNA, 210 bp, Homo sapiens
agtacttgtttggtggacctgaacctgattctctgtgacagtggcgactaaaattgtggcaccgcacttactgtgtacggaggaacaaacagactggcgtaggcactggtctgtgcatgtttgcatctataaaacagactacaactgtatcgtgattctacgtggtcctcggcctggcacactgtaatgagtgctgaattcgtaggacag

SEQ ID NO: 8525 - DNA, 178 bp, Homo sapiens
agtactggtgtgttgaatcggaaacctgatttactgtgcagatggccgagataaagaagggcacgtactaatagggcacggaggaacatagagacgagcctatggcactagtaaatgcatgtattgcatgtataaacaggactacaaccgtattctgatcctacagcggcccgacgcc

SEQ ID NO: 8526 - DNA, 306 bp, Homo sapiens
aggtacacactatgctgatggcacttagtaagtccagcgcatagacgagacagactacactagactctaaaatctgcacacacttcacgaaaattgaatggtatgtggagctgagaactgatgagagtgatcagatcacttcattgcaacagatatgccgtcagatgacgaggcacctgttcaactgctaagagccagacgtgccaacatgtctttacataaatgggcatatgatgacccacgagaaaggacactaagttacactgtgaaccgtatgtcatgaatgccgtgtagatgacgaccaag

SEQ ID NO: 8527 - DNA, 626 bp, Homo sapiens
  misc_feature (1)..(626): n = A, C, T or G
tgcaccataatccctgacgtagatgaaatgccagtgtcaggagaatgcagacatactcaatgacaacatanattataagatgaccactgaagtcttggaggctgaccatgatgtgcaatgatgagaatgataaaataaataacaatgagcttgatactgttgaatagatgttgcagctagacaagcaaaaatattgagaaagctcaagaaattcaatagaaaatgtgggacgagttagatctatggcattccacactaaatgtagctggattctgaaggttcagacattgttgaacaggagccaggacacgctcacgactggatggataacttgatgattgctttccagcagtatcagcaggtatcacagagagcagagtgtagaacctcacagttgaatagagccacagttaagatggaagaatatagagaccttctgaagagcactgtagcttggatagaanataccagtcatttgctggccaatgctgctgactatgactctttggagacactgagtcaccatgctagcactgtgcagatggctttagaagattcagaacagaagcacaatctgttacattgaatctttatggatctagaagaccgtgaatagtttatgaaac

SEQ ID NO: 8528 - DNA, 690 bp, Homo sapiens
  misc_feature (1)..(690): n = A, C, G or T
gcggcgcggaggtgannnaccatagtgccctggcanaagattgaaatgcgccaggtggnaaggaatgtcagaaaagctttataagacatagatgagaagattancaatgaagtcttaaaaagctcaccatcatatgcaatgangtagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcangacattgttgaacaggacccaggacaggctcaagantggatggataacttgatgattcctttccagcagtatcagcaagtatcacagagagcagagtgtagaacctcacagttgaataaggccacagttaagaatggagaatatagtgaccttctgaagagcacntgagcttggatagaaaataccagtcatttgctggccaatcctgctgactatgactcttttgagacactgagtcaccatgctagcactgtgcagatggctttggaagattcagaacagaagcacaatctgttacattcaatctttatggatctagaagacctgtcaataatttttgaaacagatgaattaacccaatccatacaagaagtaagtaatcaagt

SEQ ID NO: 8529 - DNA, 562 bp, Homo sapiens
  misc_feature (1)..(562): n = A, C, T or G
gtacaccatagtccctgcagacattgagatcccaggtggaggactgcanaagagctatatacaacatacatgataaggagatcagtgaagtcttgggaagctcaccatcatatgcaatgatgagaaaaatagaagaaggtaacaatgggcttcataatgttgaaaagatgttgcagcaggagaagcaaaaatattgagaaagctcaacacattcaaaagaagatgtgggacgagtcagatctatggcattccaaactaaatgagctggattctgaagttcgagacattgttgaacaggacccaggacaggctcaagaatggaggataacgtgatgattcctttgcagcagtatcagcgagtatcacagagagcagagtgtagaacctcacagttgaatagagccacagtgaagatggaggaatatagtgaccttctgaagagcactggagcttggatagaaaataccagtcattggctggcgaatgctgctgactatggagtcttggaggacactggagtcaccatgctaacactgtgcagatggcttgggaagatcagagc

SEQ ID NO: 8530 - DNA, 194 bp, Homo sapiens
tacactgtggaagctgcaggagtggtgaccgcactcggtggactgtctaaggactactgaatcattatctagacaacacaaccagtgagtctgtgagacggaagcactataagcactgatgtagtaatgataaaggaaggtaacatatgcagcttcatgaatgctgtaagaagatgtagcgacaagaaggaaga

SEQ ID NO: 8531 - DNA, 194 bp, Homo sapiens
actgtgggtgctgagtagtggactggacccgatggcctgttaagcccatctgtatcagtcgaacaacacagccatgtagttgtagcaggttgaactgacagaatggctggtgtcgcgcagggcagtacataacctgaatcgcttatgcatgtgttgcctagacacagagaagcaattcaataaagtatgacccc

SEQ ID NO: 8532 - DNA, 402 bp, Homo sapiens
  misc_feature (1)..(402): n = A, C, T or G
acacggtgggaggctgagtaggggtgacgaacctgcattgactgtatataccatctgtcacattatatccaacacaagaatatacactatagcaggttgaaattatacaatggatgttgtatctcagatctgcacataacttgcacaactaattgatgcttatataaatacataaagaataaatangacaataagtcacacttgaatatacgttatgtgatgatgagagcactgagagtgcgtccagatgtcctcagaacatcactgagcaggaatgaggtggctaatactctatccactcagacataacagacaaacgaggcacacgtgaacagngaccgaggatcctgactagcagactagggttgccagattcaacagaaaaaaatccaggattgacac

SEQ ID NO: 8533 - DNA, 178 bp, Homo sapiens
gctcaattgatacataggtaaatatacataacccagattgctactaatagaccaaaacatcgacatatgcctattgtcacgtatatatactactggcatagtgtatatctattgaaagttgatgggatggcacttcttgtcggataactgacacaaaagtgagggactcatagcaata

SEQ ID NO: 8534 - DNA, 178 bp, Homo sapiens
agtgccactgagcacagaggacacatacctgaccgatatgtgactaagatctcaacctacgacctgtggtcattgtaacggtatctagatgtggataagcgaccatcacactagactgtcgtgctatggtcccgctggtagggacctctcacctggggagtgccgactaagcttcctc

SEQ ID NO: 8535 - DNA, 450 bp, Homo sapiens
gagtactactgaaatcaagaatacatgtctgtcggataggtgacagagtaactctacgcagaacgtgagcacgttggaacggatgcagatatgtacataagagaacatcaccaaagagctcgtggcccatcagcgcacgtagaagactaacatactagtgaacgaaagcccataatgcacctcctcaatggttaggcctgtagcacacactcgcttgagaccctgacccgctaatgctacagacccgagaccaccggcaccctgtacctcggtcgtctccacgctaatcactactgaatacacggacgccggctagtctacgatatgggcatagctctcaacggcgctggcagcatgagctgagtattgtatagtgtgatcgaaatagctaggcgtatgcatggacatagctgataactgtgtgaatacagtatacggttgaaggtacct

SEQ ID NO: 8536 - DNA, 161 bp, Homo sapiens
gtgccacggtgccggaggacacatgcctggcggatatgtggactcagatctcaagcgagaacctgggccaggcgctacggatgtagatggacataagagaccatacacacagacttcgttccacgtccacgctggtgggaaacaatcatactggggaacga

SEQ ID NO: 8537 - DNA, 226 bp, Homo sapiens
atgtgctgccgatgtcataagtgcatggctgttgggatggccgcagaagtggctcgaacagacagtttataagccggtacagttaggtggagcacataaacaaaaaacacacaggagttctttccacatcatgacctcggtgaactgaatcattgtgcttactatggcttatgtctacacccactcgagtatgaccatacagaaccatactcagcagacagacgaa

SEQ ID NO: 8538 - DNA, 370 bp, Homo sapiens
  misc_feature (1)..(370): n = A, C, T or G
ccgacgtgtgcgtaaagacgggtgtcagtacagactgtgatgaaggctgttggagagactggctggaagcgtatatgacgttgtacaagacgtgatacacatagataatatatacacgctgctaactgtgacacatcatgataatgtactgtacccgtggtgttgtgctctagcttgcttttgcacgcacatngagtacgtaacatagatcctgaacatggactgaccagatccatagtagaatctgaacttgtacatctcggcgcatacagtgcatatatacacatgatgctgagccancacacaaggtgctgggagctgtggactagacctactggcagctgctgactcaggaacggagcatgagtgc

SEQ ID NO: 8539 - DNA, 162 bp, Homo sapiens
atatcggtagtagcagtgcaccgcgaataggtgttagctcaagaacgctctgacatgctacgcactatacctgaacagcgccggggaggatgaggggctcatgggcaagatcagcgtggaggactagaagaaagttctggacaagtgatatgaagttttata

SEQ ID NO: 8540 - DNA, 178 bp, Homo sapiens
actatgagatatggacacagacggtgtgagtgtgtgtgtggggaatgcgaaagcgggttgctgcttggtgcgttaggtgataaggcaaactagctgaagtgtttatcgtttgacattacagtgttgtttgttagaagtgtgatagctcataggtggtgactaatattgttttattgag

SEQ ID NO: 8541 - DNA, 194 bp, Homo sapiens
  misc_feature (1)..(194): n = A, C, T or G
taaactagacccaaaccacgacactcctcatcacgcaccccaccaggtaacagccttaacgctgcatacaaagtggtaaagcgaagggcacgcaacctcatataaagagacctgtgtgatcctcactacccagcgactgccggataacacaatcaacacctacaccatcacggcaangactacacgcacagcca

SEQ ID NO: 8542 - DNA, 226 bp, Homo sapiens
  misc_feature (1)..(226): n = A, C, T or G
actacatgatgcacanaaatactcgcactaaaacaacacacataatcaccactattgtgttctatgacatacatgtgttacacatgatcatactaatgttaataaggcaatgtaggtaaacactgcgcatacgaaatgccacctaaaacgtgcaagaaagaaggacagtggggaggagcaaggacacaataagcagctcttgaaaggaaccaatgaagcacctata

SEQ ID NO: 8543 - DNA, 178 bp, Homo sapiens
tcaggcggatctaaatagattagttaagaaaaaagatatgggtgtgatagtccgcagtgagatgtggtgggggagtgtggcttgcgtggagaatgggtggttttgaagactgagtgggtatggggcgggggagggagaggcgtgggtggctgtgggggtatggggggcggggtgacgc

SEQ ID NO: 8544 - DNA, 210 bp, Homo sapiens
gtggttattgttgcagtatcggcatgttaagatgaaactattctgccatcttactattattgtatgtgttttcatacattggagttgggggatggtttatgttggattacttaaagtaaataatacttaaaatccaaaaaaaaaaaaaaaaaaaacaaaaaagcttgtacctgcccgggcggctgctcgatactgatggtgtagtgtggg

SEQ ID NO: 8545 - DNA, 610 bp, Homo sapiens
  misc_feature (1)..(610): n = A, C, T or G
caggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttggcagaataaataacttctttaaacaattttacggcatgaagaaatctggaccagtttattaaatgggatttctgccacaaaccttggaagaatcacatcatcttanncccaagtgaaaactgtgttgcgtaacaaagaacatgactgcgctccacacatacatcattgcccggcgaggcgggacacaagtcaacgacggaacacttgagacaggcctacaactgtgcacgggtcagaagcaagtttaagccatacttgctgcagtgagactacatttctgtctatagaagatacctgacttgatctgtttttcagctccagttcccagatgtgcgtgttgtggtccccaagtatcaccttccaatttctgggagcagtgctctggccggatccttgccgcgcggataaaaact

SEQ ID NO: 8546 - DNA, 311 bp, Homo sapiens
cacatctgtagactacgtgttgcgtggagaaggtgtctgccatgtacgctgtgtacttctacggcttcaacttgatttagcgccgtggatgatgaggggctcaggggaagaatgaatgaagattgatgaaacattgtgttggtcaagtgtggagcatgggtgtcgtggctggacgcaactttgttggctgacaatgtgcagtttaagcacaacaagaaagagctgaagcacgtgtgtaacaccatcatcagctgactgttgctgagatgtagagcggctgtacctcggccgcgaccacgctaatcactagt

SEQ ID NO: 8547 - DNA, 306 bp, Homo sapiens
caagcttttttttttttttttttttttttttttttttggaattttaaagtttttttattttgaattaaccaatttaaaaaatgggctggggttaagggttttaaaaaaaaaaaatagtggtaaaagggcggtttaatttattttttgcttgtaaaaacgggaaaaaaagcaggttaagtccttgccggggggggggttggaaataattatggaatttgggggggtttggagggggagcttagggggaagttccaaaggggtgggttgaaaagttggagttttttttggggttgtttaaaaagttgg

SEQ ID NO: 8548 - DNA, 194 bp, Homo sapiens
cactctgatggtgctattattgtggcagtctctttcctttatttgaacttatctttgaagaaaagaatatggcagatgctgacatagcatatgaacattaagttgaggagtctttattagctaaatagctcaaaatacaggtggtgaatgttgagctgcctattgatggcatataggaatgagagatacgtgaa

SEQ ID NO: 8549 - DNA, 226 bp, Homo sapiens
agttggcaaaagttcactctggggaattttgtgtgtgtgtgtgtgtgtgtgtgtgtgtgtgtgtgtgtgtgtgttttgggaaggggtggttgaggaagaagagtgctaggctggtgttttcttactccaaaatggaaatactgcccttgattcattctcacacgttatgtgaaaatacatcatagcagtcttggaaaagatctacgtcttggttctgtttagattt

SEQ ID NO: 8550 - DNA, 178 bp, Homo sapiens
tgtcgtttgtggggtggtttgtgtgttttggttgtcttcctgattctggtctggtttttctctttttggtgtttttctattgtcgatgtggtggtgttgcttgtttctggttccgttggtgttgggttctccttcgtggtgttggttgtgtgctgtgttactgtttttctctctgctg

SEQ ID NO: 8551 - DNA, 546 bp, Homo sapiens
caggtcacacagcacatcagtggctacatgtgagctcagacctgggtctgctgctgtctgtcttcccaatatccatgaccttgactgatgcaggtgtctagggatacgtccatccccgtcctgctggagcccagagcacggaagcctggccctccgaggagacagaagggagtgtcggacaccatgacgagagcttgaaatctggaccagtttattaaatgggatttctgccacaaaccttggaagaatcacatcatcttagcccaaggtgaaaactgtgttgcgtaacaaagaacatgactgcgctccacacatacatcattgcccggcgaggcgggacacaagtcaacgacggaacacttgagacaggcctacaactgtgcacggttcagaagcaggtttaagccatacttgctgcagtgagactacatttctgtctaaagaagatgtgtgagttccgtcctttgttattatttttaatgtcttaagatttatttgcttaccgtaatattgacttatttaaagtgtgtaaatcaaccaccttta

SEQ ID NO: 8552 - DNA, 258 bp, Homo sapiens
tatatgcggagatggactctactctgctttttcctataggacttcatgtgtgtgtgtgtatgtgttaaagatgtgttgttggtttccataagggaattctggaaatcaaatgtggtatgtttatgtgtacttgtaatcaggttgtcagtcccttgctgatatggctttgttttgtgtagatacgaaggaatcttaatcttcggggtgggatgaagagagaattatctatattctttgaacgcgttgttttaagaatca

SEQ ID NO: 8553 - DNA, 626 bp, Homo sapiens
atttaaaattagtcccctttatgcattttactctacatgtgttatccttgcaaagaaaaagactgacatctttgagagcaagagtttttgtcttattcacctctgtataatttccaacatcgtgctttgcacattggacattcaaaaaatgttatacaagattgactgcatcaatactggagtgttgtgtgagggttaggtgctgaggctgagaagtgtatgagggagacctgagattaaacctgccacataaagtggagagaagtagcaaggtcagggctatgaaataatcccaaaaactttagaatttctacataatacagttgacactactattctcaatagagctgctttcagtctcaaagggctgtggtatgtgtgcgtgtgtgtgtggtaaaaaagggaagcagcaggggaaggaagagaagtgtgatttcacaagacttaagtaatcttgtcattgctgctttttctgccagaaaattattaccttccctttaaaaatcattttcatatacattttactaacttccatgtcaatttcacccttttttttctaataatagctactatttattcgggaccaactagtatacttaggactatgctgggtgctggagtgccaa

SEQ ID NO: 8554 - DNA, 402 bp, Homo sapiens
agacacggggtgactgaggaggaagttagacggaggacagggaacgaaggggaggcaaacaagtcacgtgagatatggaccaattgcttaaagatgctacaacacatgtggaaaagtctctagcatgatggcagggagtggggcgatgtatggatactgattgcaatgcgcactgagtcataatctgggcaaaccatgaggccgacatctatatccgaagagcggaaactacagggaggatgtgttcggtgctgactatgtgaatgatctaattccaccagagctgcaagccatggaccatggtcatgcagaggaagatgcctaccacacgctaaggataaagccagatgacctgatatgtgacatgggagtctaagatgtctgctccttgttctacatatc

SEQ ID NO: 8555 - DNA, 290 bp, Homo sapiens
gtacaagctcttacttctattgatcctgtatgatctttcacggttctttcttgggcctcaaaaagagacacttattaatagaaaaaaaatgacaaggatgtccatcctttggctcccttccctcccccctcctgctgctccctaacccccactatattgagccatggctggggctgggtggcaggacagcccaaaacatgagggcaacaacattgaggggcataacactaatggaggtgtagcataagggcccaatggctcgattagacctctggtctctcacagatatt

SEQ ID NO: 8556 - DNA, 658 bp, Homo sapiens
  misc_feature (1)..(658): n = A, C, T or G
cagtctttcttcagtgggagcccaggattctgaatctacctctttaacagatgaagatgtctgccatgagttggaaggacctatctcctctcaagagaccagtgctacttcagggactaagagaattgatctcagccgaataagcctggaaagttctgcatccttggaaggatctctgtcgaagtttgccttacctgggaaatcagaagtgacatcttccttcaacgcgagtaatacaaatatcttccagaactatgcaatggaggttctcatctcaagttgctctcggtgtagaacttgtgattgtcttgtccatgatgaggaaatcatggctggctggacagcagatgattcaaatctcaatactacatgcccattctgtggcaatatcttcttaccctttctgaatatagaaataagagatttaagacgacctgnaagatactttctaaagtcaagcccatcaacagaaaatatgcactttccatcctccatttcaagtcagacggagcagtcttgcatttcaacatcagcctctggtcttgacacatctgctctctctgttcaagggaattttgatctaaatagcaaatctaaactgcaggaaaatttttgcacccgaagtattcagatccctgctaatagatcaaaaacagct

SEQ ID NO: 8557 - DNA, 546 bp, Homo sapiens
acacgtgcagcatgtcagctcagagcaaacgtaggggcctgcggccaagatcagtgtccattttggccattacatatgacttcataaagtgactttgttggtctgtgatgccagctctctgaaatgtgcacactaacataaactgggatggaatacggttcgtgtgacagactctggaacaggctctgtggtaccagcatatatggaggagcaaaggaccggagctgagaatgagccattggcgatatgaagaagagctgggtggtgcactcgggcatagatcgccaggcttgtatattgcacgtgtcgcatgctctaggcacgttccactgccaagtgtgactaggaaaatgaccacaccgatgtatataatgatgaggaatatggagcttgcgagcctactgtggacatggctgtggagatgatgggtgagtactgtatcgaggccaagcacagatagtctgggacatggtaatgaacgagtcggtcacgatacagatgcagatgttatgcagcatgtcagctgtactactatgagacgacgga

SEQ ID NO: 8558 - DNA, 450 bp, Homo sapiens
tgaatttggataatatgtgactgaaacacgagtggcaataaaaaagcaaacatgaactctggggtttaatagatcattacatcagtatcatagaccatgtgactgtggggcttataacttgtgtagcctaatgaagtgccaaaaaagagaattatgattcaaggggagcggatgaacaccactattacagttacagtttatgctgtatatggattacatcaaacaaacaaagaacttgcttgcgaatatattatatatgctctgtgaataacggatatgtatgtagtagactgtactcatgctaatccaaaatgctcagcgatatatacacgaatgcgactggacaaactgattccttcagttactgatggaagggcggcacgatcttctgaatatattgcatacctgacatactgacgggaagaggaagtgatgagaagcctataaaaa

SEQ ID NO: 8559 - DNA, 274 bp, Homo sapiens
cacatggggattatattttgtattggcaaaatgagaccacagctggcctgccatcagatcaacataaaaaccagtattatggtatatgagatgaatggatagaggtggggtttattccttattatagagaaacaaatgtatgtcttcatcagtcttattagggacatgaatagacgaatgtacaagtggcttgcctacgagcctgtgcgcttggcctacgagatcaatagggggagacagaaggaataaacgatggggtctggacaactgaggt

SEQ ID NO: 8560 - DNA, 178 bp, Homo sapiens
acggggggaggcctttcgtgcgagttttgcttcacaaggaaattagctggaaaaggcttcttaaagaaacacaagggaaaaggaaatagggcacaaggtattattgaaattcttttaaagagcagtaggagcttgaaagtttagaacctccattatgaattccaaccacggaaaagcc

SEQ ID NO: 8561 - DNA, 194 bp, Homo sapiens
gggtacacaagttcatacagacatctgtcatattctgagcagcacatatgagagaagctttgtgttctccttgctctcttgcatgtttgttttgagcttgtggctccacagagactctcatggatttatgacaaaattggcatgcgaatgatttttgaatcataacttgtctattattatgctgtagtgtggta

SEQ ID NO: 8562 - DNA, 322 bp, Homo sapiens
actactgtagtactggaatttttattgttttaaatgggtagaaaaatggtaatataataatatatgatatataaactttaaatgaaaaaaaatgatgtattgtagatatttgatgtagttttattttttaaattaatcataaatcagactttgattgtattgtagtgatatatgactttgaatatattataaatgggaaatgttgattttttaataatagacttatatgtagggtgttgttgcggttatgttgtgtgagtgaagtgtttggttttatttagtgtggtggggtttatttaaagaaaaagaaggtagtattagg

SEQ ID NO: 8563 - DNA, 354 bp, Homo sapiens
gtgctactgggaacataatgggtcaggtggctatctaacacgaatgatcaatgtgactacatctgaacatggtgttcagtgtgtgagactcacacagagctttaccagggtgtgaagatctgctgtgtgtgcgagcttcttctattaattaggaggactctgtgatggactgacctggatggcatatatatgggtcgattgcctcagcagatgagtatctgcagataaagcgacgttatgaggtaggtgaagatcaagacaacaacataccttatttgggacgactgagtatacacagttaatgagcataaacgaaatgttatatatgatgagtgagctgatggcgagaaacag

SEQ ID NO: 8564 - DNA, 226 bp, Homo sapiens
gttttttttttttttttttttttttccagctcaacccttctttaatgtcatccagggagggggccagggatggaggggaggggtggaggagcgagaggcagtgattggggggtgggattgaccacttgtgccatgaagaggggagactgggtatttgggtcaatcatataaaaagacaagggggtgggcgaactggacctggggggggataggacggggcatgggc

SEQ ID NO: 8565 - DNA, 370 bp, Homo sapiens
acagaggacgggaacaacaaagagtctgtgaacacacatgcaaaaaaactccataatcttatgtacgcagactgaataatgatctgctgggatgggaaaatgacgcaagaacacggatgtcacgaaacataccgtataaacgaggtggtgaatgaatgtaaagaaaagctgtacgtagtcctgcagaggatgtaacatgaagatcaagcagctgataagctggcagatgacatcacacaatacataacagcctgcaacaattatatcagatagagagacagaacattatgatgaggaacaatgaaatgatagtgatacagacaacgatgtagagaccatagcttgaaatgatggaagaaagtgaagtgaa

SEQ ID NO: 8566 - DNA, 226 bp, Homo sapiens
caactaggaaatatcggagaatgagactcagaagtatgctatgggatgctaccttgaagtcagaataacgctgtgtttaccatggaataaacgttaaattactgttgctttttggataagtatgtattacggcatgctgcacgataacaccttgtcgatttaaatttgattttttgttttcgtccatctaatgcattacatgctcatctcgaaagacttaaaatat

SEQ ID NO: 8567 - DNA, 194 bp, Homo sapiens
  misc_feature (1)..(194): n = A, C, T or G
acggatgatgaaatgatgacatcatctacgagtgcatgcttgtaaaggacagcttagaacagtcctatatgaacaatcacacctatcatgactggataaangaggcctagcgttgggactgatacacacacaacaacacagtgaagatgtttattngagtgtatttattctgatgccataggtaatgtagtttt

SEQ ID NO: 8568 - DNA, 578 bp, Homo sapiens
ggtacaatacgtgcatcatgactgtcattagaaacttggggctatgtggccaagttcactgttcattttggtttttccattttcattcagaaagtccctttgttggtctgtggagaaatatatatggaagtgtcacagtaacatacactgtgatgtaatgtgttttatgtactgtttttgagacaggctctgtgacagtgatcatatgatggaggagcataggacgagagcagagaaagagtcaagataaagccgaacaagaccggaaatccggaattgtgcacagatagataaggctaccctagtcagtgacgcaggatacagaagtgcttgatctactgtgcttaggtgttttatttatatttagatgaaaaaaatgataaccaccatctaaagtcacagagatgctgtgaagagatgtggaagcaatgtgagtgttttgataataacataaaggactgaaaggggggaaatagtagcctataaagtagttaaggatgcatatgaacataaaaaaacagagcaagaaaccggaaaaaaagaaaaagaaggagggaacgaagagcaaaaaaaagaga

SEQ ID NO: 8569 - DNA, 226 bp, Homo sapiens
aaaaaaaaaaaaaagctagaacaagtcctatttgttttttttctttttttgtaatgtgtccaatttattcaagatactccaaatcaaaaacagggcacaacaccaagcccgcggcccaacacgcgacggacaagctgaaaatgttttttaagcaagtggtgggtatttttgttgaggcgcgacgaagagagaacaaaaaaccacacaaaacaaacaacgaaaaaga

SEQ ID NO: 8570 - DNA, 194 bp, Homo sapiens
acagtcacagatgaaacaacatttgtaaggaccatttatgtaaactgctgagatgttatgttttcattttggttttcacagacacattcaagctctgtccgacatgccattaaagcactggctcagaccgcacgcatattttcattttttaagtaactggtaagtattttttttctcacaaacgcacaccggta

SEQ ID NO: 8571 - DNA, 274 bp, Homo sapiens
cagggactcgggctaagatcatgtgaatccagtggatgtgggtcagatatggacagtgtgtgactagttgcattaatctatgactgaatgctgagacacacctggcggtactagaaggaatgaacccacaaaggaacgcaccagcaatgtgttcatgacacatatgatgttttttagtatatcatacacacgcgagaatcatcactcgcagacttagcggcagagaactatagagacgacgactgtcagcgagcagccgaaggtggcactccaa

SEQ ID NO: 8572 - DNA, 274 bp, Homo sapiens
gtacaagcttttttttttttttttttttttttttttttttttttttttttttttttattttaaatcaattaaagatttatgaaatttattggggtacagggaataaccgggacaaaagggggagaaaagttggtaaaacaagtgtattttaaatattctatacaattttttttgtgtacatatttggaagtgatgggtatttaaaaaaaccgcatagaaatccacaaccttaaatattctgcaaaacaaaacattaggttctctcttccttaat

SEQ ID NO: 8573 - DNA, 162 bp, Homo sapiens
gttagggggaaaattattaatgattaatttttattttggtgtgtattggtatttgtgtttcttattgtatatattgtggaaggtgttgggagtgaagtttttgatttagagatttgtgtgagttttattattataatgattgatagttggtagaataaagta

SEQ ID NO: 8574 - DNA, 274 bp, Homo sapiens
aaggcttttttttttttttttttttttttttttgggtgggaactcatttttttattcttatatattatatattggatatctttacgaatgggatactttccatttggggtcagtgacaggtggtaaaaaaatttggaaacatcaggtctgaaatagtctgagatggtatggacttataaggggcaactggcacattcaaggactgtatgaaatggcattaaaggactgggttacaatggaggggtatctctaaaccgggagtaactggaacgca

SEQ ID NO: 8575 - DNA, 354 bp, Homo sapiens
ggtattgattatggaaaaaatgaatctgtttaggggttttttcccttaaaggaagggaaggaatttttttttatgggaaaaaacaatagttaaaaaaataaattgttttttgggaataaataacacgttaaatggaatggtataaaatatagatattttgttaaaaaagtttacctttgggtataataacaaaaaggggaatgggttttttttgtaatgaaggccggggtttatgtggaagcaaccaatattaagggggttgggctgtcgatttagctttgggttaaaaaaaatggttttggggctgttaattgttatttttaggggggaaaggggggtagaaagttgttttaa

SEQ ID NO: 8576 - DNA, 434 bp, Homo sapiens
gcacgattaggaatttatgcctattatcatagggatcgacatggtcctcttctctctcacctgtgatgctactgatatcttttgtcatctttctgattgtgggatgaggaaagtcttcatgtttttatgatatctctaatcttgtacacctcggaggaggtgtgttttcatctggggcacttgtaatggtggagctttgctcgatatgccatttttgcactggataagatagtaagcatatttggcaactggggggcaactggatagcataaattaaatcttaaatgctggttgtgccatctatggaagtaaacataatgaccaggggataatgcctaggctgggtgagtatatcggccctgaaatataggcttgtatgggcatattcttggactaattgccacaagacgaaggataaagagaaaatagaacag

SEQ ID NO: 8577 - DNA, 242 bp, Homo sapiens
ctatgttttgttgattatgttgtattagttagaatggtattgttttgtttttggttgttgttaagtgtggtgttgtgtggtgttgtgatggagttgttttggtagaagtggtgtgtgagttgatcgatttagtaggggatgtttgataatgggttaaatttatgtatgttagggtaatatgaatgatttaaatgattttgtgtgaaggagagattttatgaatgaaaaaagaaaggtaaaat

SEQ ID NO: 8578 - DNA, 450 bp, Homo sapiens
ctcggaggtgttggcttggttgatgcttcgccaggtgaggcgattggtgtgtgcgtgtcacatactttttataatcacaattcacatccagtgttgagcttgcggcgttgctgtggatgaacatgccacacactgtccgacaggtggagagatattgtgaaagtgtggggattggtgagtgagtggttttgtgtgatgaatctggcgatgtactttgcggtcggatgagtggtgtctgaatgagtgcgtgaaggctctgacatatttgacaggagtggtgcgttttgtggttagtgtcaccgtacgtgatactgatatgtgatagtggaggagatgattgtgtatattgagaggatggtgcaagagtgaagtgaaagagagaaaaagttgggagggagtggagagattagaggaagatgaaaaggggatgtggtgtgtgtgtatgtgagc

SEQ ID NO: 8579 - DNA, 290 bp, Homo sapiens
caggtacaagcttttttttttttttttttttttttttttttttttttttaatttaaatgaaataaagaatatgaaaattttttgggttcaggggataaagtggaaaaaatggtggaaaggagtggttaaaaaaggataaataaaatataataaatattaaggttgggtaaaaatttggtaaggaggggtatttaaaaaaaatggaaaaaaattcaatacttaaaaatttggaaataaaacaaattagtttttttttatataaaaaagggggggggaatgtggtggggtta

SEQ ID NO: 8580 - DNA, 402 bp, Homo sapiens
aagcttttttttttttttttttttttttttttggtttaaaggtttttttttgaaaaaaaaaaaaaataaatggggttttcatgtttttggaaaaagaaaaaaaaaagggaagggggacattcccattgggggaaatttttctttgggttaaattattttaattatgggaatgaaaacttatatcaataacaagggacattaaaaaaatattaattaaaaaaaagggaagggaatggggggagggagtctggggttgggagggaaggggtttatgggaaaacattcggggttaaggggactttcctggaaaatttctgggtttggggagattaagttaatttcagggtattcaaatttctcgggcggggggccgatgcaccctaatgattcgacccactagcc

SEQ ID NO: 8581 - DNA, 226 bp, Homo sapiens
gtgtttttggatataatgaaaccttttaagggggttttacgcttaaaggatggaatagaatcttttttatggcaaaaggataatgatctaagatataatttgtgtggtgtgtttaaatcacgatttccaatggaatgtgattaatatctatctgtgctcacgtagtcttctctgtggggtcatagggataagtgcgattgggtctcgtttgtagctaacgagaggg

SEQ ID NO: 8582 - DNA, 338 bp, Homo sapiens
gcacggaggatcattgttctctcttctttctctgcaggcttgacaagtccatcttatatctttggtatatcagcatccgcacgttcatgctggctaaagaagctatcttggatgattacattacatatgttagtcttattgtggggatactgttttgcggatgatggttgtttgaaagctgcgatttgatgtaccaagttttgattttctgccttttaaatattttgttttttttttctgttatgttgtagggtgatttgttggtggttgagtctttctttaccattattgtaacccttgtttatttttgggatattttatgtattgtatttaatttt

SEQ ID NO: 8583 - DNA, 466 bp, Homo sapiens
  misc_feature (1)..(466): n = A, C, T or G
cccaagactctcatgattgttcgacctttggggctatttgtatttatgacatcattcaaatacctgctttttgaaacactaatgcctacctgccctgggtggtaacaatgttgtaagggttgctcatttgagtgaatgtattttatatttttttcatcttggtactagttttttgttatttctttcgtaatattctacttgggtttgatgtatggctactatctcttatgttttcactcatgtacttangggctttttaggttttagttgttaatgtgtgtggtattttgttctctatattgttcatagatattttatttactgattgtagtgttgttaaatttagatgatttcatgatgaactcattaaccaggaaatggacgtgcgtaatacgtatattttttgtttttgactgtgtgttctttaataagttcttgaattttctattgcgagtgttagatggag

SEQ ID NO: 8584 - DNA, 210 bp, Homo sapiens
gttgtgtttgtggaaatgtgaccttttttgggggtttttgcttctaggggagtggatggttatgttgtttatggaatgagaatttttatgtaaaaaatattttgttttgtgtgtattaaaagggttattagatgatgtgttcttattttatatttatgttaagggatggtatttttgggttttatttacaagagagtgttgggtgtttgt

SEQ ID NO: 8585 - DNA, 338 bp, Homo sapiens
  misc_feature (1)..(338): n = A, C, T or G
ctggccttcaaaaagtcgtagtggctattttttttggacaaaagtaagaaatgttgttttaggagtaacacagttcaaaagagctttaaagaagcatgcacacttatcacaaacaactctntcaggtggccagtctgatcttggatataattcattatctaaagatgaagttagaagaggggatacatctactgaagacattcaagaagaaaaagataaaaaagggagtgattgtagttccttgtcagagagtgagagtacctcgggggaagaagcatgcatgtctgtgctgatcccagtgaatcctgggtccaggagtacctgcggtatttattttt

SEQ ID NO: 8586 - DNA, 210 bp, Homo sapiens
gggttagtgaacttgtgacttttgcatcctaatgtatgctaaaaaatttttacttccaacaccatgatattatgagcgactgttttgtgcttgctaatgatgctacctgggctgtgatctacacagactgtaagtctcattggggacaaactgctccaaggaactgttgtgattgtaacgctgctatcgggatgaaacctggcgcttcag

SEQ ID NO: 8587 - DNA, 466 bp, Homo sapiens
tgattatggaatcgtgaatatatacaagggttttttcccgtataggaattgaatgcactatttctgatgtgggacacatgctctttgatataatacattgatgtatgtgattgaattatgtgtctcattgatgatgatatacatactttgatatacatgtaatgtcttctttatagtgtgatgtatgatagtgcaattggtcaccatttgtggctgaggctaggggtagtttggaggattccaatcttgatatatttagagtatgcatcatacttttggttgaaattattcttgtcttgtgatatatcagatattagctcaagggacttgttatcaatgtttttgtcgaatgactttgatgatgttgctatgctggcacatctctcagaagatgtcaagggcacattctcagattgctccacatcctatgcattctattgaaattctctggctgcgtctcatcaca

SEQ ID NO: 8588 - DNA, 178 bp, Homo sapiens
gggtagatcagctgcgcccatcatctccgactgcatgcttgacaagtcacatacttacaacacacgtatatcaccaaccgcaccttgatgctggctacaagagctaaatagggagataacaacacaccgtacggacactggggacatatcgtaacacaggagtcataatggagagaaa

SEQ ID NO: 8589 - DNA, 530 bp, Homo sapiens
gtacaagcttttttttttttttttttttttttttttttataaaacaacgcaataccaacgaaatatgagacaaaacaataaaaaccaaagaaagaagatggggatagtagaaaaaaccaggttgcttgcaaaaaagacacatattaccttaggtccccccaaagataatgatggactttgaaaaaaaccaaaataaaatacggaaaataaatattaaataaataaaaacataaaacctactgttataaataacataaaggagagtttaacttggatgagatgcttaataaaattaaagtatgatgcgataagaataaagaactattaattggacaagtccagagaggcacaaattactatgaacactaaaccctccatgatgggcaagaggaaccggcaaccccagcggggaggtttatggtctggggggacgtccgattccaggggagaaaaaccagagcttgtaaacgttattgagacttctactggagagacgcacaatatatttcacaccaatctgttgtgggagg

SEQ ID NO: 8590 - DNA, 386 bp, Homo sapiens
  misc_feature (1)..(386): n = A, C, T or G
taccggttggggtcccaagtgacagtgtaattccagggggaggtggagcggctctcgatgttacgtgacatggaaacgcgctggttttcattgatgatgccaatgtcaagcttcatactacctcctggcacaggcgggcaactctcangcttttggaaaaaagtatgtcctactttggggattttccgagctgccgcctcactcagaaaggcaagccccaatatcgacagcagcaagtacttgaccatggctgggccatgcagggtcttcactgtcatgttgcgctggtggcttactttgtgcaggaagctctttctgtgaatgtatcttcctgaccctgccgggcggaagataaaacaaaaacgagaagaacaagcaagacaaga

SEQ ID NO: 8591 - DNA, 162 bp, Homo sapiens
tattaaaaaacctaattcttcacccaatttttttaatctgccaggaacacccaataatatttttaaatatatcactttaatagacttttcttttagatgtcttttcttgtaaaggaagaggtgatatgttttcatattgatgtgcttaattcaagttgatta

SEQ ID NO: 8592 - DNA, 386 bp, Homo sapiens
tttttttttttttttttttttttttttttttttttttttttttttttttttttttttttttttttttttttttaaaaccaaaatattttttggaggattatttgggggtttttttaaaatgaatggggtggtggaacagggggcctttggggtttgggggggggtcttttgggggttccatgcctgaattggggggattaaatttttagggggcctattcgaccagttggggggggtttttgttttttaaccgtgggccttccaattttactttttttggggcttggggggggagcccaatttggcacagggggatttttggaggggggggggcttaaagccacaggggggggaaaaaggggggctttcattgggaccctctaaaa

SEQ ID NO: 8593 - DNA, 162 bp, Homo sapiens
caagcttctttttcttttttttttcctttttgactttatcacaaaagtccaaattatgacccatgaaaaaatagagcgaaataaccttactgatgaaagaatacatggacctctgcatagatcacaaggacatggggggagaagggcgcgcccacgccgcct

SEQ ID NO: 8594 - DNA, 194 bp, Homo sapiens
  misc_feature (1)..(194): n = A, C, T or G
gaccgtcctaagtaatcacaccgtacactgcacacaaacatgggcaaccagcagctgctcctgcatgctttaagtgtaggaatnacatgaacatgaaatagtggacaaggagaaacaacaggccaaggaaccagctatcataggacaagacagaaatgaaaagacatgaccaacgtactggagcggcgtgatag

SEQ ID NO: 8595 - DNA, 402 bp, Homo sapiens
  misc_feature (1)..(402): n = A, C, T or G
tgcttaaccgatggctctgatgtggtcagtgaccttgaacacgaagagatgaaaatcctgagggaagttcttanaaaatcnaaaagagaatatgaccaggaagaagaaagggaagagaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaanagcctgaagattcctggcttatagcatgcgagcattgaaagaccaatagcaaacttatcagtacctgcccggcgggcggntgcaggg

SEQ ID NO: 8596 - DNA, 210 bp, Homo sapiens
tttttttttttttttttttttttttttttggtttttttaagtttttaaactttttatttgcataataaaaaaattgtgcattccaataattaaaatcatttgaacaaaaaaaaaaaaggcactctgaataaactggattacagcctggcaggacacctgggccagcttggggctactctaaaatccactggcggcccaccccacctcccc

SEQ ID NO: 8597 - DNA, 210 bp, Homo sapiens
  misc_feature (1)..(210): n = A, C, T or G
cccacactgtcaaatgtcaactccaccagcatctganaacaatgagtagtatgatgaaatgtagaaagaaggaaggtggtaggtaaaggagcggaatgaacgagtggggaaaggaggaaggagaganagagaaagaggaagagaaaggaagaagaaaaagacagcatggcccggcctagacacaaaaccaggaggtgatcaagctcagca

SEQ ID NO: 8598 - DNA, 210 bp, Homo sapiens
cgctgattgaaacaccactatattttctggatttaaaaaaaccttctactacccctcaaaatgaagaaattcgatgagttgttatactaataagatagcggcctatgactgaaaatgctgtccgccaaaatggacgactggtcaaaaatgacacactgtatggacaatcaacaacacacaccacccccgaaagcaacgccggcaggaccg

SEQ ID NO: 8599 - DNA, 290 bp, Homo sapiens
gaggtcgagtcctgctgggcttggcaacgagggactcggactcggcagcgacccagaccacacagacactgggtcaaggagtaagcagaggataaacaactggaaggagagcaagcacaaagccatgatggctacagcgtgtgctggtggaaaccaagataaagatgcccattttgcaccaccaagcaagcagaggctgttgtgttgtccaaaatcaaaactgcacatcaacagagcagagatctcaaagattatgcaagaatgtgaggaagaaagtttgtgggaaaaag

SEQ ID NO: 8600 - DNA, 258 bp, Homo sapiens
cgggctcggaggccgcttcacgttcacctcccacacgcccggtgaccatcaaatctgtctgcactccaattctaccaggatggctctctttgctggtggcaaactgggtgtgcatctcgacatccaagttgggggagcatgccaacaactaccctgagattgctgcaaaagataagctgacggagctacagctccgcgcccggcagttgcttgatcaagtggaacaaattcagaaagagcaagattaacaaaggtatt

SEQ ID NO: 8601 - DNA, 338 bp, Homo sapiens
aagctttttttttttttttttttttttttttttttttttttttttttttttttttttttttaaaaaaatgaaacattttttttaacagaaagagggtggggggggtggggtaaaaaagggtttttgagaaagttttaaaccgacccaggtcttgggggaaatttttggggttaggggggggggaaaaaaggcctaagctttaggagggggaatttgggggttttttgtggttttgtttaaaatagaattttttttggcttttttttggcactggtggtggggggggggggggaaaaggggggcacaggtttctgtttttgttttgtccccagatgttt

SEQ ID NO: 8602 - DNA, 162 bp, Homo sapiens
gaaggcatgatgttttgattttttttttttatttattatgctaaataagggttaaacagtgctacaagccggcaaacaaatagtacggatttcacgggagaagaagcaggaccacggcgaatagaaatgatgccgaaccaaaaagctgagaacatgttggga

SEQ ID NO: 8603 - DNA, 402 bp, Homo sapiens
tttttttttttttttttttttttttttttttttttttttttttttttttttttttttttttttttttttaaaaccaaaaaatttattggatgattaatggttgacttttttaaaatgaatgggatggtgcaacaggggccctttggggtttagggggggttccttcagggaatccatgcctgaattggggggatacaatttttaggggccttattcgaccacttcggggggtttttccttttttacccttggcactccagtttttcttttttttgggcttggcggggggcccacattggccaaagggcgatttttgaaggggggaggccttaaagccaaaggggcgggccaacgggggggttttattgggacgctttcaaaaagaagaagtttcttttgtta

SEQ ID NO: 8604 - DNA, 494 bp, Homo sapiens
tacatcttaaataagtctaataattttggttcatcttaaagtaaaaatacattgaaatgaatgagagagatctagattttaaaaaagttgaccattcattattgctggaactgaagaaaggaaggatacactggcatcacgatttgtctacataagtccagttcatctcgcgtttgttttggcaagaagaggacactacaaaactcacagtgcagtcaaaacaaaacaaaacaagaaaaaagcacaaaaatggtcggtggggaaccatataacaaaactacatctcaggcagctctttctcaaggaagattctaagattttattatgtggctaattctaaattggaaatggaacatgccggtatgtgaagcaattggtgctaggactttaccctttgctgatatgcaatgataatgtgatgagctttagtgactcttgaatcaggataatcacactctttaggtacctcggccgcgaccacgctaatcactagt

SEQ ID NO: 8605 - DNA, 178 bp, Homo sapiens
  misc_feature (1)..(178): n = A, C, T or G
ctctngagcttgtatggaggtaagagtagaaacaccattatgattgtaataaacgagtgcttgaatgatctggttatgggtggctgatatcacactatggtgtagctcatgtgagtgatgctcatgatgctagtaataccgatgtggttatggatggagactaatanggggattgatc

SEQ ID NO: 8606 - DNA, 194 bp, Homo sapiens
taaggaaagaagtaagaatgaaattgaagaaagatgattatgaaaaagaagggagaaaaagagaaaaataatttttttatgtttttatggttttatttttttttgatatttttttgattaaatttattttttatgaaaagaggtttgtgttgtttgttggatttttttttgttgtataagggattgtttgttga

SEQ ID NO: 8607 - DNA, 306 bp, Homo sapiens
gtactgtttggtaccttggattgcatgagttggtgggggccggcgggcctagccactgggcgtggaacgacaccggtaatagtgttgatggagtgtggaatagctgttacccttcactatgaccgctataacacatgctgaacgatggatcccattgcacaattgtatagtgttggaggcactactgggagcgattcttatacccaacaagcgatacaccgacataacaaatggtgggatgggtataatgatcatctgtcgctgccacatcgataaatactgaattgatagggaatatgttggttg

SEQ ID NO: 8608 - DNA, 306 bp, Homo sapiens
  misc_feature (1)..(306): n = A, C, T or G
gacgtgctccacgtggaacggtggttccatactgtcccttctgtacactatacaacgnatgtgagaagcaaaacangattatgatgagatatggccctacatggtttaccgacatatgcttatatgaaagactatgacttattctgcgttacatcacctctgttgtacaagatggtaacttgcgtataagacatgatgagattggtgtggttttatttgaatttttggttttgatttggtggttatttttatattgtatgagttgagtattatattttagtaacggcaaatgtgtcacccacattg

SEQ ID NO: 8609 - DNA, 242 bp, Homo sapiens
gggcaggtgtacgcgtcgttatctaatttttctgaatcggaggccaaaagaacaaacaagggcacgaaaataggccatgccttttttggacatttataaaaggtttttgttttattttatatagatggttgattatttatagtggtgaacagttgtataagatggttggttgttgccatgtttttgaaaatataatggatagattgtgttcatggaattggtttatattttgataatagaat

SEQ ID NO: 8610 - DNA, 226 bp, Homo sapiens
  misc_feature (1)..(226): n = A, C, T or G
ggctactgntccaaggaggtaaaaggtagcttactggttgtcctcccattcaggttanaaggagnaggtctgcggnctaggnagnntcaataaagtggattggtcttagtggggcgaaatattatgtnctttgttgtttggtatatatggnagggatggggnattattgtctaggtatgagggatggtatagtgaataggggcaaggcacgtcctccctagttttg

SEQ ID NO: 8611 - DNA, 194 bp, Homo sapiens
  misc_feature (1)..(194): n = A, C, T or G
gctgcaacggctattattcatcctagtgggntaatggagcantaggttagtattttgcgttgctgggtttggtttaatccacctcaactgcctgctatgtaggcataatattgagtatagtgaggagaaggcttacgtttcagtgtgggcatagtattgggtatatggagcgtagatggtggactgtacttgtg

SEQ ID NO: 8612 - DNA, 274 bp, Homo sapiens
ctgcaagcaggggggacgagcaacgtgagatgagcaggggatggccaggtgaagcggctggagatgttttaatgcaccgtcgcagggtgcaaatgagagagatcacaagcagcaaaacaactggatgagacgatgggaggggcaaggatgccagatgtcaagagatccatagcgctgagaggaatgtgggagggggatgctagagtcatagtaaaggggaaaccctatgctagctgtcaacagagttcacagggggtacgggataactgtcggt

SEQ ID NO: 8613 - DNA, 157 bp, Homo sapiens
  misc_feature (1)..(157): n = A, C, T or G
gntacatggncctgnttctcctatatggnaanaaaaanacatcccgcccctgnaatttcccagntcctctgnagnatttaatgggtgcctaaggagcatataatgaatgtcattgccatttacgaggtacctcggcccgaccacgctaatcactagt

SEQ ID NO: 8614 - DNA, 177 bp, Homo sapiens
ctactgttccaagaatggtaaagaggtagcttacgggtgctcctcgaattcagttaaaaagaaggggccggcggctaggaagtcaataaagggattggctttatgtgggcgaaaatattatgcctttgctgttgggcatatatggcaggatggggaatcacaccaccaccacaacct

SEQ ID NO: 8615 - DNA, 306 bp, Homo sapiens
taggggggggccccggggcgaggggccacaacaatgtaaaggcttatgctgggaggaaaagggcaaggttttgccggtgtttttttaaaaattatttttttgataggagggaagaaccggccttcgaagggaaaataaggtacctactaaaaaggggcccccttaatttaaggttaatgtgttaaagggggatgcccgcggtccctgggcggcaacaacgtaaataacaagggaactgggggccgcgggaggggggaaaataggggaaaactcccaaacagggggatgaatagttgggattttata

SEQ ID NO: 8616 - DNA, 466 bp, Homo sapiens
gatgtgattatcctaattcaagagtcactaaaactcatcacattatcattgcatatcagcaaagggtaaagtcctagcaccaattgcttcacataccagcatgttccatttccaatttagaattagccacataataaaatcttaaaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcatgatgccagggtatccttcctttcttcagttccagcaataatgaatggtcaacttttttaaaatctaaatctctctcattcatttcaatgtatttttactttaaaatgaaccaaaaaaattaaacttatttaaaaagagaactgccggg

SEQ ID NO: 8617 - DNA, 402 bp, Homo sapiens
cctgggaagaaaatttggttggtggagggaaacgggggcagctccaaaagggatgctgttgttaggggcttaaaaacatggcctgcccccgggaaactgaacaagggatagagggggagctccccaaggctcctgtgtgttttactaaaagggcaacagtctcaagtgggggctggaggggaatacactgtttttaagggttagggaaaagagggtgaggggatggaattgaaaaaatatatttatttttaaaaatattggggagggaactctctactgaccttggaaaacgggaaacaagtgggcccctggggcgaaacaaccctaataactagggaattggggggcgccgggggggcaacactaggggaaagcccccaacgcgttgggagaatatctgga

SEQ ID NO: 8618 - DNA, 338 bp, Homo sapiens
ggcacgcgggcggggtgggggcgcacacccccccttctggcgcgcgcgcggtgagggggggggggcgtgggaggatggggggatacagtatcaaatgaaaaataaatgttaaaaaatcaaaaggggcgggctccttaaacaattttggcgggccaaaatgtgagggtatggaggggagggaaaaaaaaagggggggggcatggggggcggtgggtatatggttctttacggggggggggatagggatggacgcagcgggggcgccccctacgacaaaccacccgcaccctgccctccacacatgcggggctctctaaacatggcttccttctaagaac

SEQ ID NO: 8619 - DNA, 258 bp, Homo sapiens
tctggtcaaaagtcaaaaaaatggagtttacaatgggcataaatgtaaaaagtgactcaaatgggaggaaaacctgggggggaaggaggtatgcgggtgagtaaaaacttgcaaagcaggtggttaccctttgccatggaacgctcgccttaatacacctgattaagcacacaaggctggttgaaacattaggcagggagggtttgtgtcggctgggcaggaaggggggcatcacgctggaagaggaaagcagcgact

SEQ ID NO: 8620 - DNA, 242 bp, Homo sapiens
gctggtctggacggtcaagaaaatgcgggataaactactcaactggctactacgtggaatgacactgttatcgtcatcgtacagaacgacgacatccaaacgcatattgtagagatacggaccagtgtatggaccagggggatcgaggaaacccgcttcatctaatatgacctacacttataatatgttgaatgaggatggtgagtggtctgagcggaaaaaggggacccactgataagagg

SEQ ID NO: 8621 - DNA, 226 bp, Homo sapiens
  misc_feature (1)..(226): n = A, C, T or G
angaaataagactgagggttctatctacacttgtagcggacatcaaacaactaatgagccaattcctcctgctgcaactggtctaacggatgcagcagtttatactgatcgacatgatctctaaagcccataagccgaaaaatggcatctgagatatgctgggccaggtgatgttgtgacgagatgtcagtgatcagatcatctaccttgtcataggccatgaact

SEQ ID NO: 8622 - DNA, 162 bp, Homo sapiens
aattgccaaatttgggaaaaacacttgtgtgtgggccaaaccctgtggttaaaagaggttaattaataaatttactgacggggggaggggggttaaggtattgtgggttaaaggactgttgcgtaaaatgtctattcgctgcctacggctgccacaaaagcc

SEQ ID NO: 8623 - DNA, 194 bp, Homo sapiens
tgattagagagacggggaacagagccgcctttctacttggttgggcgtgttttccctggtcttattgtttgttctggttttaagctccaaaaaaggggggggccatgttatcttcaatatgttttggttgtgggggcgggtggtctttttatgtgaccaacagatgtccagaaaactagggagggaattttatt

SEQ ID NO: 8624 - DNA, 498 bp, Homo sapiens
caccctaacagagggaaattttttttaaaaaaataaataaaataaaaacaataagcaaagaaaaatggatgtaataggggtgggtaaactaaaaagctacaaaaaatgggtccctccacggaaaaaattatggaactgtaaaaaattgtgggaagaaactatttggaatttctcgagtttagtaaaacagggaaagaataagggaaaaagtgggataaagaggatgataaatttgggtaagggtgggggaattcaagccttccaactaaataaaacctattttccataccccattatgggggggacccaggggaacgggggcccatgttctggaaaggaattcggggagcgggggggaaaaaaaagcactttttggccaaaatataggggttttggtggtttcgggcctttgaaggcggggggggacacacagaagggggctataatggcaacacccctaataaagggagggggcttcaaagggaatttaaaaaaata

SEQ ID NO: 8625 - DNA, 514 bp, Homo sapiens
aaattcttttgtgaattatcgtgaggaaaaaatattttttattaaagaaaatctttaattaaacgagggggactaaaaccaaaaaaaatttaccaaaaagttaagcaccttaatcaatgggttcaactctatttttcgggcggggggaaaaaaggggggaaaaagccggggagggttggagggggttttttaaattttaaaactaattataaaaataacttgggagggggaaaaaaaaggcttaacccgggtttttaaactaacagcacagggtttcattcaccctttttacctaccccaaaaaaaaaaaaaaaaaaaaaaaaaaaaaagttggcccctgggggggacccacgctaataacttagggattggggggcggcgggggggccgaaattgggggaaagctcccagcgggtgggaggaatagttggatttttttttagggtaacttaaatagttgggggtatttagggatatggtggttttggggggaaattgtgtaccgggctcaacc

SEQ ID NO: 8626 - DNA, 178 bp, Homo sapiens
ctgtgttggtgggggggcgaaaaaaaataaaaagaagggtcttgagtggggtggaaagagggggaaaaaaaaaaggggggggaaaaagggggaaaatagggggggggggaaaggagggggcgcgtggcttttttggtggttgcgagaaagaaaaaaaccccttttgagggacgcgccc

SEQ ID NO: 8627 - DNA, 482 bp, Homo sapiens
aaaaaatgggttaaaaaaaaaaaaaaaaaaaaaactggtgctaacattttttatatttggggttttttttttaataacattaaaaatggaaagagtttttattttaagtgcctctggggttaaaaacaacctccatctccttggttaaaaaaacgctttgggcccctggagggaaaaaaatctgtgaggggtgggaaaatcatccaacccggaaaacatccttcaacaaaccgcccaagcaaagagtatgagggggggacatcaaaattagggtggggattttaatggaaatctctctcataacctcttttctttgggtctacagtaggggtaaaaaactccaaaggggatttaaaaaaaccaaaaattatttaaagggcccctcgcccgggaccacgccattctttagggatcgcgggcccgcgggcgggcggaccatggggaagaccccccaacgcgtggggtgcattggttggttttct

SEQ ID NO: 8628 - DNA, 482 bp, Homo sapiens
tagtgcatagtttttattatattcgttttccggagtggagcgcgtgtttgttccgtttgtgttcgtctaagacgtgaagaaaagctgatggtttgtggtgtatatatgttacacactgtgtggagtagtgggcatctgctaagtgaagcccacaagcactgtatttatccctgacctgtatactaccatctgctgccctccctagccgcaccaatctactaccttataccaagtattgcggatatgatcacaggtcataccagacaatgcagtgaacaagtgaaagaaatgcatgtggtgtgaagtgtgatatataaaaagcccatgcagaataccattgatgccctgatggaagagaaaatggcagcaaaaatttcattattctcacaagcctgaaacgcgtgaattacaagggcttaaagaaatactaatgcctctaacctttcctatagctgctttttatctgaagggttccttgaatg

SEQ ID NO: 8629 - DNA, 322 bp, Homo sapiens
gttgtgacagtgaccgtgggggatattgagattgagataaccaatatcactacgggcacaacatacatttatgacgctagagcaagaggccgagaataacgtggataataaaattgacaaagacagcagaggcctcaatacccacggactcctgtcttgacccgaagtagagactgttaagtcctgatgcgtcgcctgcccttccttcattgctgccctggaatgtacctgcccggccgttcccccaaaacagcccggaactggggctggttaatgcaggtgatgaaccagtggttggtattgtgtattgttttgttttaaa

SEQ ID NO: 8630 - DNA, 338 bp, Homo sapiens
tgtgaactgggacctttagtggtgggcattcatgctgcatatttgtgtgttgtgttgacctggtggggacggaacatcgagtcctgggtcgatgatggagctgatggagggctggatgactaatgggcggcccaggccgggggggaccaaactccaacacaagacaggagcgagacgtgaggggagggagggacacacggggcggccatggacgcagacagcaccgtgggctgtgcagtctttgttggaggcggagcacaagccggtatgaggatagggataaaattaatgggtatcacttccctttttttgtttttggtatttttaaccacataaat

SEQ ID NO: 8631 - DNA, 306 bp, Homo sapiens
gtgaaaatatggtgtttaggcgttttgtggaggttggtggggtggtctatgtttttttttggatcttatgctggaaaattggtagagattgtagatgtttttgtatatgaaaagggttttggttgatggatattgttttaaagtgaggagaatggtaatgtgttttatgtgtttgatgttaattgattttatttttagtttatgtaggtgtttattatatgtatgtcataatagtttggaaaaaggcagatattatttaaaaaagggtaaatataatgatgggttaagaagattgaagatagaaaa

SEQ ID NO: 8632 - DNA, 240 bp, Homo sapiens
tacatttttcaagctgtttttctttatgtttttgaaggaccatttttaattagctctttgatacaaagtaactcagaacgtcaaaacctgtacccactaaagggaaggctgccgggaaggcaaatggaacaggaatggagcctgtctcaggaaggccagccgcaggtcctccagaaaatcaaagaagggaagaaactctgagtttgaggtacctcggccgcgaccacgctaatcactagt

SEQ ID NO: 8633 - DNA, 194 bp, Homo sapiens
gtccccctctttttttttttttttttttttttttttttttttttttttttttttttttttttttttttttttttttttttttttttaaatagatttttttttttgaattttttgaaattttgaatttaaaatgaattgtggaggggggggggagtttcaatatgttggctgtgttttgggactgggttggcggc

SEQ ID NO: 8634 - DNA, 493 bp, Homo sapiens
acatattaaataagtctaataattttggttcatcttaaagtaaaaatacattgaaatgaatgagagagatctagattttaaaaaagttgaccattcattattgctggaactgaagaaaggaaggatacactggcatcacgatttgtctacataagtccagttcatctcgcgtttgttttggcaagaagaggacactacaaaactcacagtgcagtcaaaacaaaacaaaacaagaaaaaagcacaaaaatggtcggtggggaaccatataacaaaactacatctcaggcagctctttctcaaggaagattctaagattttattatgtggctaattctaaattggaaatggaacatgctggtatgtgaagcaattggtgctaggactttaccctttgctgatatgcaatgataatgtgatgagttttagtgactcttgaattaggataatcacactctttacgtacctcggccgcgcacacgctaatcactagt

SEQ ID NO: 8635 - DNA, 546 bp, Homo sapiens
acaagcttttttttttttttttttttttttttttttttttttgggagggttttgggtttttttttggttttttaaatttcaggaattggtttttttatttaattcattaacctttttttgaaaatatttgaaaaaaaaaatttttttttaaatttttttttttggtggggaaataaaaagttggaggttaggggaaattaagttgaaaaagaaatgggaacatccacccccacctttttggaaaaaaaaaaatgaatgggggggaaaccaagggtagaaggggaacagggggtagggggggcacgggggggggctggctttccacctccttacattttggttacaggggcccaaacccatttggggggctttggaaaaaaaaatggcaaggggttttggagtaaaaaggggggggggggaaaaaattctggatttcgggccctcacaaaaaaggtggtttagggttttcaagctgggaaaaacacattaaaacccgggggacttttggggggtggaggaaaacaaaaaaagggaaaacaacctgga

SEQ ID NO: 8636 - DNA, 290 bp, Homo sapiens
gggtgtgatatcttttttttttgtatatatatgttgtggttatggattatgatatattgtttttaataatggagatagaattgcttgttggattgaaagggagtgtttatttatatttattaagaaatagtataacgatagattgttggttaggttaagattgaatatatatttataaattaatattgagtatattatttgttgtgtttatattatgaattaaataaattgatatgatttattttattatttgaagtcattatattaataagattttattaggtaaaggt

SEQ ID NO: 8637 - DNA, 274 bp, Homo sapiens
ggtactttctatgaaaagggtttggccatatagttgttgttgacgttctgggtgaaaatggaagggttttgtggtccgaataagggggggaaacgataaacagggtttcctcatgaagaagggtgtttggacccttggtcgtgtccgtttgttattgatttgggggcatttctgttccagactaaggaaacttggacaaaaaaagaaaacattagttcgtggttgcatggtggatgtaaatttgactgttttaacctgggttattgtacaaatg

SEQ ID NO: 8638 - DNA, 338 bp, Homo sapiens
gtgccggcaccacatgaaatgggggaccctccgtttgctgttcatcagttgtgcatccttatacagttctgttggtaggatagaacaatgagcagacatctgcacgaggatgacacggctcaagctacatgcatgtgtacggtgatgtgctatgggccacaaaggtaccctatgcgtacatggaactttgattacaactagggcatatttatggctgatttaatgtgataacagtccccagtagtcgcttccgaataaatgaaaagtgctctactgtggggtctggcaagaaaaaagcaaaaatcatgatattcacgctcacatgcaaagaaagtata

SEQ ID NO: 8639 - DNA, 162 bp, Homo sapiens
aaccttttgcttatgctgttttttatttgtttgtttatttctatcatttgttttatataaaaaaaggtggaaagttgaatatatacaaaactaacaagataggaaacctggcaaataatacataatggctctaataatcacataatagcaagctgtcctgag

SEQ ID NO: 8640 - DNA, 194 bp, Homo sapiens
tgcacatgaaacacaagatgagaaagtgtgaagtggagacacagaatagtaagaaggggacaactagagacaagtctgttgaacaagagaaacaacaaaacaattgctgattcatgttgcaacaatatagagggacatcactggggcgagatgccggtgtgataatgtacactagcggtggagccttggcaccg

SEQ ID NO: 8641 - DNA, 322 bp, Homo sapiens
gcacaaaatctagatttgctaggctcgaggtagagaaggacatatgttatagtagatgaaaatgatggaatagcaatgagatacaaaatgcaactaaaaatgggataatctagatattagagaggacttcaaacatgcaaataggaaccacaggtgactatgatggtatatcgatttatgtgtgtgagtattcatggtattacaggctgaatgtaacagacacaagcaaataggttgcctaagactgtgtccttgttctgtcggatgtgggcggggaggatggtcatcttctctggtgtctcactgttagactttgaagcgg

SEQ ID NO: 8642 - DNA, 178 bp, Homo sapiens
gtacaatattggtaattattttatatctgtgaagggtgtgagttaaaaaaaataattcatagaatgacaaaaagtacttaactgttgtgttagctggagtgaaaggtatgatgatatatattaactggaaacagatgaatgtccacggagctttctgttggagaggacattgcagccg

SEQ ID NO: 8643 - DNA, 466 bp, Homo sapiens
gtaccaatacgaccaattgtgtacacatcctgtataggcatgtgcatgggcttgacaatgggacgagtgggtggtaggatgcagtcaaaagcctcaagcatagtggttccaatggaattgtgcatacttaggggtgtactttccatccatatgaactattgcttgtaagcacattggcttccaagatgttgagagcatttaaaacaaagattggcacaagagatactgtgtatgagatagagagaatttttttggtgatagggatggattcatttgcaataagattatgtctataatagcagtttggcggattcaggcgaatccatgatgtaaataccgaccgtggggtcgcaccgaagctagtgtgttggatctaaaggtttgctatatgtggtgaccatcagtgtttaatgccatctacaatatggagcatctctcccttaaaccatctggaacagccacagcc

SEQ ID NO: 8644 - DNA, 258 bp, Homo sapiens
taaattaattagggaaagggttttgaggggggggggtggaagaaaggggttgggtttggtttgtttctcctcccaaaaaaaagccactaaagcagttacagaaatgaagggtaaaatgggggccacaaagccatggtatgtagctttagctcagggaaaaaaagagcgccgggctcacctcattaaccagtatatgcagagatgggcaggggtacctgccgggggcgccgggcggcgggtcgcgctggggccggggct

SEQ ID NO: 8645 - DNA, 178 bp, Homo sapiens
agtactgtttttgttttttgtttgttttttgaagcgagagatgacggtatgggggaaaaatggatgggaaaaggggaacaaaggagagggaggatgcgaggaaaagcaccatccacgcgatgagagaggctattagtgagggacagagtggggacaaaagagagcaaagggaacgtga

SEQ ID NO: 8646 - DNA, 386 bp, Homo sapiens
catttttttttttgttttttttttttttctttctattttttttttttttttttttttttttttttttgactttctttgttttttttgtgatgcttttttttttttttttttatagtaatcaaaatataaaaaaaaaaaaaaggaccggggggaaaaaatctggggaaaaactaaaaaaacgggggggaaaaacaaaaaaaaaaaaaagaaaaataaaagcgggcgagccacaaatggggggggaaaggggaaaaaaaaaaaagaaaaaaaaaaaagtaacaaagggggccccggggagggggggcagaagggaaaaaacacccatcccgggaggggagaggggggaaaaaaaaaaaaaaaaaacaccaaaaaacgcccttcgggca

SEQ ID NO: 8647 - DNA, 450 bp, Homo sapiens
caagctttttttttttttttttttttttttttttttttttttttttttttttttttttttttttttttttttttttttttttttttttttttttaaaaaacggggcattaattaaaaaaaaagggggacaaaagaagggggggggggaagtcacaccaaaactgggggtaaaagaggggggggataaactggaaaaacaaatcaaaaagggggggcaagaacaagaagggagtggggaaattataagtgggaaaaaagccaaagataaaaaaccaccacaaaagggggtccatatgggaaggattcacacatgaggggggtggatcaaggaaagggtcctatccattgaaaaatatatcattgcggccatcatatgaagcgagagcaccctgcaatgaagaatgttaaggggggggtggagagggggaataaaattgggggaatggccac

SEQ ID NO: 8648 - DNA, 394 bp, Homo sapiens
ctattttttttatttttttttttttttcaacatatatacaaaacatcatggtaaaatgtaaaaggaaaatggagtgcgactaggaataatgaataatagaagattataaataaatacgatattaatataaattaattagcggtcataatataatgattcacaacgaaactctggaacatatataatagcctcatgacattactatttaaataaacatgatctgcatccaaactatttaatgcttatttactgcattaccttcggagacagggtctagctctgtcgaccaggctggagagcaggggtgcgatcttggctctgtggaaccgacgcctcccaggcccaagcgatcctcccgcctcacacctcggccgcgaccacgctaatcactagt

SEQ ID NO: 8649 - DNA, 162 bp, Homo sapiens
agtatttttatttttttttttttttataaaaaaaaggacaccacgaaaaaggaagacggcaaaggaacccacacgtaaaacaaacacaaacggcaaaaagaaacaactccctcaaaaacgcggccggaagacaacccaggggggggggagcgaggaaaaaac

SEQ ID NO: 8650 - DNA, 482 bp, Homo sapiens
tttgtttttgttgtttgtttggtttttggggttctaaaaccgggaaggggggtattcttggttccagcaaacgtaaaaagggaagaaaaatgggtaaaagggaacaatgaagctcggagggaagttttccggggggacaaggggggcttaaaggtaaaaaaggtgtctgtaagggatgtcggtgggggaaacgtggcgggggacagaaaaaatgacccaccaagggaagcagggggcttaactgctaaggggataatccggaacaatccaggcaaaataagggcgggttatgcccttgtatggaatggccatagggttaaaatggcatgcaggtttgttgagaggaaggaaaaaatggatggccgtgcgggtaaaaagctggaagatggcccaaatcgttgagagtgtggtgatgttgccatgggggatgtggtgcggtgagagcacatgtgtgtggaaagcctctaatactacgcaacttt

SEQ ID NO: 8651 - DNA, 386 bp, Homo sapiens
gtacttgttttatttgttttggggtatttttataaaacaaaaaacaaaataaaagccttgaaaaataacggggggcaagcaaagcgggaaaaagggggaaaagcacctcccggaggggaacccccgggggcaaggcccagccaaagagacgggacagagacaagaaaccgggaaaaggaaatataaaaaaagggaaagggcgagcccacagaaacccaaaggcggcacaggggggccggggcgggagaacggggacccaggaagccaggaaaaagagggaacaaaaaaaagggagacggaggagggaaaaccagggaaccaccggcggcagcaggcgggggcgaagggggggaggcaaggggagggacagaggaactaaaaaaagg

SEQ ID NO: 8652 - DNA, 159 bp, Homo sapiens
gtacaaatttagtaatttatttgtaaattctgccagaatactttctagctgctttgtaattttttaagagtgttattttgtttttgtttttctgttctttgttgtggctcttgttttcatttttgttgtacctcggccgcgaccacgctaatcactagt

SEQ ID NO: 8653 - DNA, 274 bp, Homo sapiens
ctgatccatcacacatactgcgtggttctgatatagggtgagtttgtcgttgctgctcattgatatgcaataaggaacttaaggaggccttctgacagaagtcactggtcctgttttgtctgaatgagctgcaaaggttgacttgggtggtggcgagaactacatgacacagatgagagtgtgattatgggaaatgccctgaacagttctgagatgctatatatttggaaaggcgtgttggtttgagtgtgggaatatcaaaggacaccaccag

SEQ ID NO: 8654 - DNA, 480 bp, Homo sapiens
gtacggctcggagggccgcttcacgttcacctcccacacgcccggtgaccatcaaatctgtctgcactccaattctaccaggatggctctcttcgctggtggcaaactgcgggtgcatctcgacatccaggttggggagcatgccaacaactaccctgagattgctgcaaaagataagctgacggagctacagctccgcgcccgccagttgcttgatcaggtggaacagattcagaaggagcaggattaccaaaggtatcgtgaagagcgcttccgactgacgagcgagagcaccaaccagagggtcctatggtggtccattgctcagactgtcatcctcatcctcactggcatctggcagatgcgtcacctcaagagcttctttgaggccaagaagctggtgtagtgccctctttgtatgaccctttccttttacctcatttatttggtacctcggccgcgaccacgctaatcactagt

SEQ ID NO: 8655 - DNA, 316 bp, Homo sapiens
gcaccacgagtttgagaaggagatgggagtgtgatggatgccaaacgaatattctagtgctccatcagcttgcgaggatgtacagaaccggggaactgagatactcatatccatgttgggctgtaaaaaggctgtcaaaaccataagatgcacgatggacaatatgctgtgggcctggggacacatactgaaagacggggggaggaggggaaggggagggggcgaatcgttggtagcggggggaaagtggaagacagtgagaagacctaggccgcgacgacgctaatgactagggaattagcgggcgactgggagc

SEQ ID NO: 8656 - DNA, 514 bp, Homo sapiens
gcgtgctcaagctttttctcctttctatgtttttttatgtatttatccttgccgtgtgtagcatgtgactttaaaaaaaaccaacattatccacaagggataggcacatgaagggggagatggtggttgaaaagatgttgacctagaaaataaggcctagcacacagtcactgaaagactattggatagtacagaggggacatgaaagacggaagtgtgtggagaacattgacagaccaaaagttgaagggggaaagaaaaacacaagacggccatgtcaccgaatgttgtggagtggggggggggaggcgctcgggcaacagacaggccatataacagacgatctacagagagggcacagggacagggagcacggtgaagcaggagccagggaggtggaaagcgacatggccgggaatggggagagccaaatattgtgatctacagatagtgcacctctgatggcgagagaccatgcacctgaagctctgtatgtataatggacggcccaaac

SEQ ID NO: 8657 - DNA, 194 bp, Homo sapiens
tacaagcttttttttttttttttttttttttttttggtaatggtctttttattggaaaaaaaaaaaaaaaaaataacatttacaacatgggaaggaagtaaactgtaatttctttgaacaacaatggtggtgggtggggtgaaaaccacaaccccaaaccacttcgccggctccaaatgatgggataaaaaggt

SEQ ID NO: 8658 - DNA, 162 bp, Homo sapiens
ggtactcgtgcgcccggcttcgcttttctccgcacgccgtctgacaaaccggtatggctgatatcgacatattcgataaggtgaaactgaagaaaaacagagacgcaagaaaaaaatacactggcttccaaaaaaacgaatgaacaggagaaacaagcaagc

SEQ ID NO: 8659 - DNA, 242 bp, Homo sapiens
gagtgcaaactttttgcttctattcatctacaatgtatctttccatgtaaatcccatatcttgatgctggggtcctgtgagcagcacacagccagtatcggatagggctgaaaccaaggcgttgatgatgtgcacaccatgtatcgtgtgaaggtgagagactttggtgaaatccgatatcatggtatgatcatccgtgcctccacacacacagatggatccatctggatatacaaccaccg

SEQ ID NO: 8660 - DNA, 290 bp, Homo sapiens
tcatataaaacagcaaaataaaatagtcgtgggcacaggccagtgattctgcagttagagccgtgtggactcggtcccccatctccggtgagggcgtctcctgcacacggcacccatgcttcaggtcgcacacacgtgccgtggacccaagttcacctttggaggtgtcaatccccccaagaagatgttgctaacttggagtttggggcctaggctttcatcagagtcttccccacagaaagcgaaatgggaatgggtccttaataagctacgggcctttgttcacagca

SEQ ID NO: 8661 - DNA, 162 bp, Homo sapiens
ttagaaaggcttgtttagggtttaaaagactggttgttcctgattgtttattggtcccatggtgttttctgtgttaacctgggaaaggcagccttaattacctaaaaaaagaaaaaaaaaaaaaagaaaaattatgtgtgagatttttttttaaagtgggga

SEQ ID NO: 8662 - DNA, 162 bp, Homo sapiens
gactctggggtgatgaatggggagaggagagaaagtgaatcactatatcattctatacataagaatcagtccaggtggattaacaattttaatatgatagagaaaatatatatactttagaagatataggaaaagtatgtgtagtcctctagggtggggaag

SEQ ID NO: 8663 - DNA, 258 bp, Homo sapiens
ggttttaaatttggaaatctaaaatttttttccaacaatcttttgggagggtggacctgggttttttcttttaggttttggtccctctgtttttttattttttttctttttggaattttatttttatttgtttttggttcattttttatggttatataggggggggggtgagagaaataacggagaacgtgggtgagcaagccggtgttaaaagatgggaaaagagtgtggggcaccaaaaaccttgttccctcaagt

SEQ ID NO: 8664 - DNA, 482 bp, Homo sapiens
  misc_feature (1)..(482): n = A, C, T or G
taaaattatactggtggcggtttctgtctatgtgggggatgttctccnttattaccagttacatcctcttcagagctacccgaaaacccctctcaggaaggacaccacgagtggtctacaaatggtttcttttgatctacaaactcagctatgcatttggtgttgtgggttacttggcgatcatgtttacaatgtgtggattcaatctgtttttcaaaatcaaagctagagattccatggattttggcattgtgtctttgttctacggcctctactatggagtaatggggagagactttaccgagatctgctcagactacatggccttcactatagggttctacagtgtcaggcggttggctacaaggagcttatcggacaatatctgggccagttgggggcagaagatcattggggagcgtgatgaagaaagggtcatgaaaacatctatcagcgtttctggtatcttgtcttcattgatt

SEQ ID NO: 8665 - DNA, 162 bp, Homo sapiens
tgaaaaggatagtggggtgtgggaagggacaaaggaaaggaatatatggtgaggttaaaatgaagaaaaagagtaaggcaaagaaagtattgagatttatattttgatggggatggttgggagggttgaggtgggaattaatttggaaagaaaaatagatgt

SEQ ID NO: 8666 - DNA, 578 bp, Homo sapiens
ataataaaaacaatgaaaataacagtatgtaaataatggtatgtaaaaatctaacaatcacgtgaaattgaagaatttggcatgtaaaatgaataatactgtcttcccccaagaagtttagcaccaaactggctctggtgctgagataaggaattccaggccaggcttacatcgcaactcagtcctcaaaagccctctcgtgcagaatgagaaggcacaagcatatatacccattttgttttcaccttccatctctctcaatcaaatcttacttctcattttaggaagtatatagtccaaaatgggcttttaattactctttgatccttccaccccaccctgcccttttctttcctagcaaggaaatgacaatgagtgtggcctatagacaagggtaattacagatacaccagtgggctgtgtcgcccaggataaggggggagagctcaaagctggtcagtgtgtgtgctcctctctccacttagctgtcattccaccctgtgcttttctacttccctcttacaaggggcaacaggggcgggggagccccacggcacgtccaaggcataggttaatga

SEQ ID NO: 8667 - DNA, 162 bp, Homo sapiens
  misc_feature (1)..(162): n = A, C, T or G
gcccagctctgggaactgaattangaaactcaaatcgaatagggaagcaaaaaaaacaaaacaaaaaaaacaaaaaaaaacaaaaaaaaaaaaccctattttaaatggaaagggagcttaaaaaaaatttttttaagggagggaagaaagggagaaaatttt

SEQ ID NO: 8668 - DNA, 162 bp, Homo sapiens
actttgtgatatctcatagggcatactggtctttcaccatttcgcccccactttttgcccatatttcccaagctccccccctacagcaccttccatgtgctcgtgccttcatccagcacctgctccccaatgtattccgtggtagcaggtgatgtaacacac

SEQ ID NO: 8669 - DNA, 210 bp, Homo sapiens
gtatagagagggagaggtttttttgttttatagtagagagggggtttcaaaggtgttaaggaggatggtttagatataatgaaatagtgatttggaatagtaggaatacataagtgatgggaattaaggggatgaggtggagaagtatgagaaggattattatttttaatagaaaaaagaaaaggaagagaaaagaggtgaggtgtgagg

SEQ ID NO: 8670 - DNA, 562 bp, Homo sapiens
gagcggccgcccttttttttttttttttttttttttttttttttttggcgtttcaccttatttatttatgtatttattgagacggagtttcccctcttgtcgcccaggctggagtgcagtggcacaatctcggctcactgccacctccgcctgacaggttcaagcgattctcctccctcagcctcccaaggagctgggattacagctgcaagatacaaaccctgtcctcacttacgtacaattcatctctgacatgaagcagtctcccggggctccgcgtctgttcgctctgggattaaattcgcgtaggcactggggaggcgggagctgccttcgcagatatttagcatatgaggatcgaaggccagtgggaaccgtgaggagacgcacaaccgtggtttgggcccaggggcctggggggattgcgagggggggtcagctgccaagaaggccaaaaatagccggacgggtggggggggaggcgggcaaggagaagaagctgggcaatggcggctggtagttctgggtgcttcctccggtcccttcaaccccacctccaccg

SEQ ID NO: 8671 - DNA, 226 bp, Homo sapiens
cggccgccctttttttttttttttttttttttttttttttttttttttttttttttttttttttttttttttttttttttttttttttttttttttaaaaaaaaaaggctttaattttttataatggattcaagccaacaaaggtgttcaaaaaaaattcaaaaaggaaaaaaggtcaaaatttaaaaataggggggaaattttcagtttgaaagggtaaaaggat

SEQ ID NO: 8672 - DNA, 226 bp, Homo sapiens
cctttttttgtttttttttttaaggatatgtttttattgctaccagagggttttatcttcagtatacatgcgttgactggcaatacctgtgttcagactgcagagggagctcaggatgcagaagtcatgttaagaaacataaggctggggagggggggggagtaagttctattagaaaatgccaatagcttaacaaacctgagggtattacattcagttataccat

SEQ ID NO: 8673 - DNA, 338 bp, Homo sapiens
agcttttttttttttttttttttttttttggattttattttaaagttttattaagaaaaaaaaaaaaattaaatggggtattcatggttttggaaaaagagaaaaaaaagggaaggggaacaatcccataagggaacattattctttgggttaaataatattaattatggaaatgaaaactaataacataacaagggaaattaaaaaaaataaattaagaaaaaggaaaagagaaggggaaaaggattctgaatatgggagaaatgtgtgttatggaaaaagattcggggttcagggtaatttcctggagaatttctggctttgaagcggttaagtca

SEQ ID NO: 8674 - DNA, 258 bp, Homo sapiens
gaaggaacagatggactcatacactccacgatgtaagctggactagtccaacttccaacgtccgtataacgccatatgtatcttattgctgtatatagtggcaaatagaatagacaacaagtgagaggtacgactaataggggagaaaaggaacacatatgtgataggtgatgagctctgacatctgatgaaataggtgacgaacttctaccatgaacaaaatgtgttgccccacttcagataggttcatcatcttag

SEQ ID NO: 8675 - DNA, 242 bp, Homo sapiens
tgattgtggagttattcaatatataaaaagggatattcgagatgacttgaatgagctgtcttattattcgtgtactgagatgaatgttcaacgcataagtagtatatgagttcatacaagtgatggctgaagtgctgtcagcagctaatatggtgagcgaaaaggagtcagatggtgtttcgaggtcgaagagcatccgagttaatggtggtcctgcgcgccagattcgaattggaaatatc

SEQ ID NO: 8676 - DNA, 418 bp, Homo sapiens
gggtcctgacgcccaggatgggagtttctgtgaaggcactttcagataaacattaatattttaatttgattcaaaaaggaaaatggaggggctataaacctgatttttttaattaatttattttaaaaagtcaccagggataataagttcggacagttacggaaatatttttaccatacaaaataaaaagataattcaaaaaatttcttatgggaattgacgtccagaatttaggtccatgttcactagctaacccacttagtagggtggggcgagcacaaactctaccttcccatttctaggcctgttcctccctccttaaggggggaataaatattaacagggtggtggtgaggtttaattgagataaagatttatctactaaaataactcagtgatactttatggttatagtcaa

SEQ ID NO: 8677 - DNA, 258 bp, Homo sapiens
gtacgggccaggctcctaatctttgggattcattggcaaataatttaagtgtggtgtattattaaatagacaaaaggtaagttgcaaggttgaaggatcacttgataagtgagactggtgatgaacattgatgcgcttaaaagtgaagatgcttacagaataaatgaagagcagctgtccttctttcctccttctagatgttcatgctgtggcatgctcagaggttcctgcatggataggagatgggagcggagtgat

SEQ ID NO: 8678 - DNA, 226 bp, Homo sapiens
ggttcgggggggaggaggtaatcccttcatatttcaatgttttctttttgcttattttttgtattctggtgtatggcgtaagtacagataatgcttcatctcgaatggtcgtttttatataatttttttttttctcttatcatcatgattcatttaacaaaatgtttcaagcttactcaggtatgctatagtgtactacagatgaatgttgggttaaatatagagg

SEQ ID NO: 8679 - DNA, 194 bp, Homo sapiens
agctttttttttttttttttttttttttttctttttaagttttctttttaaaacacacaaaattcaatttttttttccttttttttgcaacagaaaaaaagaattgaaattggacctcccccttagggaaactttttcttttggttaacttattttaattattgaaaataacacttatataaataacagggaca

SEQ ID NO: 8680 - DNA, 162 bp, Homo sapiens
cttcgttttgctttctcttcctttcttcgtacaacaccatgtatatgcaggtgaaagagatgaccaagactagtaggctgaattagaaatttatgctgactctatctaataataattatgttggtttatgtttatctctattaaatagtgcttttggggaat

SEQ ID NO: 8681 - DNA, 162 bp, Homo sapiens
gtgtacgcaggagtccctgcgttgttcagctcctgtgcttgctgtatttttgcactttctcacagacctatatcatcaaacgctcataactactgtgctattgagtggtaactttgctgatagggctgctcaattcatgtatgatggagataatgctcacgg

SEQ ID NO: 8682 - DNA, 210 bp, Homo sapiens
aaatatgaatgttaatatataaagataaagtattgggaaaaagaattataattaaatgtcacatataaaatggattgatgggaagaaatgagaaacagggtaaagtataaaatggaagtggatcaagaataaaaaaaagagaattatgaacaaaaaaggaaagaaatatatagtcgggattacaagaaagaaatgaagtcaaataaaaaa

SEQ ID NO: 8683 - DNA, 194 bp, Homo sapiens
gattatggaaattgaagttatttaggggtttttaaattaagggaagtggaggtattttttttagggaaaaagaatattaattaaaaaaatagttggtttttgtgtatttaaaaagaattaaaaaggaatggttataattaatattttatggttagaaaaggtttagtgttgggtttttataaataaagtgtgga

SEQ ID NO: 8684 - DNA, 162 bp, Homo sapiens
ataagaggataaaaaacttcgaaagtaaagacacagaaatgacgaagctgaaggctgagagtctcccttctcacttactccatgctttatttagcattccctaaacggtgaggaggcagcggctgttatggtgtgggacaaaaccagccaccgggagatgat

SEQ ID NO: 8685 - DNA, 226 bp, Homo sapiens
gtctctgttagaggatgtgactgtgtggatggactatatatagagaagatgggtgtctagagcttagtgctaagagcctatgcgcgcaagagatatctcaaattcatagttagatgaaatgcgaggaatgtgctgctatgattgacaagaggagtagaaatgatgtactcatcctcttctacacgacataatgcaaaataggatgacatagattgtgggaatggat

SEQ ID NO: 8686 - DNA, 546 bp, Homo sapiens
tattattatcgcactcgagtctaagaggctgcactcaaagcaataagctgtgtcaacggtgtccgaggagggtaatagttgatcagaggacattgaaaatgaatcttgctgcttcatggtatattaatatctgaatagtcagacaactgtaatattatggaataaacacatcgtcaaatatatcattaatatcataaggataggtacacatggaacgttatgtacctcggacgatactgactgttatcactattgtatccggagacgtgtgcgcgtcgaccatatctgagagcgcggacggtgtaggatgcatatgtagactatgctatattgtcgtctacatagttggacatattcatggtcatagctgtcttctgtgtgatattgttatctgttcactatatcactcgacatacgagtcgtaatcatagagtgctgtgtgtgaggtgtctactgagtgagctaactcacatatatggcgtggcgctctctgctggcttgcctgtcgtgactcctgatctgagccagctgcattaatgagtcgtc

SEQ ID NO: 8687 - DNA, 562 bp, Homo sapiens
tggccagattacgaagcgcaatgttgagattgagaatttgtctatagagagtacatattcgttcagcaccatgatcactctcatcaacgatgtttattgagaggatggttgtccaccttatacaggctcatggacctataataacgctttccaattctacacatacgtgtagacgaggtagtctatatactcagaacatctagcctgctctgtatctacagtgcatgagtaagtatatgtatatgtatgacatagaattccatatcgaagaggtcgtgcaagtacactggtgctgatgctgtggtgctcgaggaatatcggctgctaatacacgtatatctattgaattgtatcagatgatatgtcacatcagttgtgatcatcactgtcgtaggaatgttagatagaatattatatgtcatctctctatgactaggcttgtactcctggtgcataggatactgctgtgtgtggtagctgtccgtgcggacgctcgacatcactagagaatgcacggatagagtgtaagtcgagcagatggtagagatctgagcgcagtgag

SEQ ID NO: 8688 - DNA, 402 bp, Homo sapiens
tggggagctatggagtctggtatggtctttgagattccctgcttgagctgggaagggggtgggttctcgctaggtttaattgtactgcaacgtatcagagcaggcgccactagtcttagagagccagagcgtcatctgttgtagccactcggctcagacgtggttgtgtggaagcgactgtggatgacacacaaagtgtgcagtgttgtgttcctatgtaactttatttatggatcttgaattttgaatatatactgtacctgaccgggcggccgttcgacatgactactgaattcgctggggagtgtaggtcgactatatgtgagagttagaaacgcgttggatgaataatcgagtgtgtgatagtgatggctatataccgtggagtactcatggtagtag

SEQ ID NO: 8689 - DNA, 194 bp, Homo sapiens
aagctttttttttttttttttttttttttttttttaagtttttaaactttttatttgcatattaaaaaaatagggcattgcaataattaaaatcgtttgaacaaaaaaaaaaatgggactctgattaaactgcattacagcctggaggacaccttgggccagctgggcgttaaccaagatttcacgggccgccc

SEQ ID NO: 8690 - DNA, 194 bp, Homo sapiens
ggctgcgggacgtgatagacgattaaggtatgattgaataattatactgatatagtgtgtaagatctcttagagagagctgtgtaattattcatctatatatttttactaactaacgtgaaagaaaggatgctggatgagcttgttctgagagtatctacttgaggctgggatgatactccaagggttgatgag

SEQ ID NO: 8691 - DNA, 162 bp, Homo sapiens
gcgggccgaggatatcatgactagatttatatgtaatatttattattagggaaagttaagaaggaacagaagactagaaaagaagtaaaaactttgatgaagagaggggtgtaagaacaggatcaagacacattaatgcctaataccaacaacgagcagtgg

SEQ ID NO: 8692 - DNA, 226 bp, Homo sapiens
aaagaagatacaagctgacctgaataaaatttgtgcaggaggcgaagaaaataagggtataattatttggagaccatgggaacacgcaaacattatgcagaaatctatgttgtggataaaagtataaatgattatgatgttaaaaaaatggggattgaacataaaggacaagtgtgtgtgatgaaccacagaggaagtaaaagcttaagccatgaaattactaaaa

SEQ ID NO: 8693 - DNA, 194 bp, Homo sapiens
  misc_feature (1)..(194): n = A, C, T or G
ccgcgggccaggctactaaggtgcaagtatatgtaaattgttttgatacctttanagtgaagggagccttttgagaaaagttggtggagtgcatcgtatcataaagcgggtaggtagtacatgtaggcagtaaatattatttaaaaatgtggatagtatactgtgaagttggttggtctagaaataccagtttc

SEQ ID NO: 8694 - DNA, 242 bp, Homo sapiens
cacctgccgattgcctatgcccatgtgcctgcccttccgggggaacaaggggtcggtgggggatgacggcgatggaacggacgcacagaacgctagccgatgatcataacatcgttgatgagaaaaatgatatgcatgacaggagtagaggttggcgattgtattaggatcattgagatcaaaccacatcacccatgtgccacactgccacgactcataaagggtgttggtatgtggatggt

SEQ ID NO: 8695 - DNA, 402 bp, Homo sapiens
ccatgctatttgattttcctcatttcaactgttttgtatgaaaatcttaatacctatgtatatggtcctaactataggccgcacatttcttttataattcctgttggagagagaggggagggaaatttatgtgaatacctggtgaccttccttgactttccaggtttcctgatgtcattcattgattatgttctccttcattatttttatactaacttaaaaattgagtatttggagaaggttttatagtatttattgatgaatatatttagcatatcaaaatttttggttttaaaaactgagtaatattaaagactataagcaaacaaaatttatagaaccggtcattaagtaattgcttaaaacatggagcccattactctaacctttataaaaattaac

SEQ ID NO: 8696 - DNA, 274 bp, Homo sapiens
gagtacaagcttttttttttttttttttttttttgtattttattttaaagtattattatgaaaacacacaaaatcaaagagttatccatggatttgcaacagcagagaaacagtgacaagagagaccatcacccataagggggaacacttatccctttggcgttaacttaatataaaataattgggaaatgatcaccctaaatatcaatagacacgggcacataaaaaaaaagattaaaattaaagaaaaagggaccaggaaactggcgggaga

SEQ ID NO: 8697 - DNA, 770 bp, Homo sapiens
ggttttttttttttttttttttttttggttttgaacctttaataaaagtaaaaaatgaatgcaaaaagaacacaatgttgaaaacttagtatgaatgtgaacctcactagatgttcaaatctggtagagtgcaaattttgttcatactattttacatttttacaaactcaaatcactttggttcatatattttctataaactattggcaaaaaaatcctcaaatttacattcttttggctacattatttctaacagatatagatttacttccggtttcggagagaaagacttattgtgtgtgcgtgatcaagtctgttttaaagattcactcgctgctttcatctaataacttctgggttttcataaaatgctgacatcttcattggaaatttttttcatgtaactggtttcattttcagaaaatatataagggggtcattccaaagttcagaatgatcctatttttttaaaaaacaaaattcctgtaaaacaaattaactccaggaacttaaaatttactccaagacatttccctcaaaacaaagcaaaaaaccccagcaaagatcggtacatcacaaaaacaaacacaaagaccagcgctcacaggcaagttcctcttagcttccattctgctgactgggggcttccatttaaaaagaggcttttaatcaagccactttcacagaatttaaaacaaaacaaacacatgttaattgcaaaaaacaaaaaaggaaaattattagaaaaaaagaacaaaacccaaaaaacg

SEQ ID NO: 8698 - DNA, 178 bp, Homo sapiens
tagcctcagcggggaccctcagcacatgaatacttcctcattcctggccccctcccttggcccttctgcctctcttcactgccatacaattgtgtgaaggatgtagggaagtggaaggaattaaataaagaaggaaccagcggtgaaggcccccccgccccccacagactaggtcggc

SEQ ID NO: 8699 - DNA, 178 bp, Homo sapiens
aacactatgcattacatacacacaaacacacaccacagtcataaagccctaatgatgtgctgattacaggtcaatattcaggtgagcattctttattaatttatcaaatgaaaagctttttgctacctctgccattcatgaaagacagctatggaaaaaaggaacctggtaccaatat

SEQ ID NO: 8700 - DNA, 370 bp, Homo sapiens
tggctggactgcagtacagcggataaaacagggaaacgtaaaaagtaatcagatgactgttatcgagatggagagcataccagtaaaggtagcactgactgcaatatttgtaatataaatctaaagtttatatgttaatgaatatcaatatatatatggggtatatataattacactaatcagtgacagaagcacttataatagcgacttctgagtaatgaagaagagaaatgatgaatatatgtattatctatagggcctatatacggtgactgcctcactatgatcctatgggttgtgagtaattatgcaaggctgtgtgaatgcacagctgtatctgaaggggcaactacgcagtgctgcctaagca

SEQ ID NO: 8701 - DNA, 209 bp, Homo sapiens
gcccggaggatgagcatgagcataaaggaagtgtggtaggacagatcaaagggaagtacatggaatgtacgaggtttttcaattaggaatcaaaaaagaaacgaggagacttcgaaaagctgactaattattagggaactgacttggatgctgtaagcaaagctatacatgatctgatacaagagatgggcggactggcgttagcatgt

SEQ ID NO: 8702 - DNA, 322 bp, Homo sapiens
tgattacaaagctgtatgtcatgggccaactatgcaataaacctaaactagagctatgggctgtgagtggatttcacttgatgataccatgaagactgatttatgatgtgatactatccattcttctgtcggtatgaagttatgcatgacaaaatgatggagtgcttaaatgggatgtcatatggacaaagaccgtgtgaagtgaccctgatgatagcatatcatttcaggataactaatgactggcaggttgcaaggattgttgacgactgggactggacatgcgcggataggtgattgctcacggacatgctcgagaaaa

SEQ ID NO: 8703 - DNA, 578 bp, Homo sapiens
atcttggtgagaatctcagcaaaccaccaagtgatcctgaggctaaccctgaagtttcagagagaaagctgccaactgaggaagagcctgcacctgtggtggaacaatcagggaaaaggaagtcaaaaaccaaaactattgtggagccaccgaggaaaaggcagacaaagaccaaaaatatagtggagccaccaaggaaaaggcagacaaagaccaaaaatatagtggagccactgaggaagaggaaggcgaaaaccaaaaatgtatctgtgacacctggacataagaagcgtgggccttcaaagaagaaacccggtgcagcaaaagttgaaaaacgcaagactaggactcctaaatgcaaagtccctggatgtttcttgcaagaccttgaaaagtcaaagaaatactctggaaaaaatttaaagcgaaataaggatgaattggttcagagaatctacgacctgtttaacagatccgtctgtgataaaaagctgccagagaaactacgcataggctggaataacaagatggtgaaaactggtggcttatgcagcactggggaggagaggggggcccgg

SEQ ID NO: 8704 - DNA, 354 bp, Homo sapiens
aactggtgctgaagataatgacatcagcaaccgagactaaggcaatacgtcattgacaccaatacaatgagcctgtgtgtgatgggtctgttcgtgctagtgctcgattttggattttgatctctatcagtatcattgggcttggactctgacactgccagcggctgctgttacactgatagggagaggaatcggactggggaggtagaggacaatgacaacgagaacatcagctcctgctcacaggcggctgtggtaagcaaagaaggccacgctgtacgcactgtaccctgcgagcagggagtcctgcaggggcggcctgggcggtctactcatgaatctgaggtcgattgt

SEQ ID NO: 8705 - DNA, 226 bp, Homo sapiens
tggtattggtaataaaattttgatctctaagaagattaaaagaagtagggaagcgtgatgttagaagcgatggcgattttctggtaagcggtctatggtctgttttattataaactaggaaaagaacataacagctcacaggacccaacttattgatgaaatgaactggagtgctgacagatactagggatagaaatagatgaagaagggacggaaacaattacta

SEQ ID NO: 8706 - DNA, 498 bp, Homo sapiens
agcatacacggcagatatgcaccatgcaatgcccgagtgaagcactgcctgaggacaaagagggcttgaatgtcaggagtgtgtgatggaaggatggacggcgcggctgcgaagatgctgacagatggacagacccaccagaggaatgaggaggctgcaatggtcaagagagtatccggaacgatccagggcgaagaaacgccggctatgcatctgcattggagtggcacaggggtcacattgcatgcgagagacggtgagcgtggggagaaataagatcgccgtactggaaagatgctggaagagggccggaaaccatggaagtctggtgaggctgcaatggtagatgtggatcatggctagtccatgtgagctgagtagttaatcagactaggcacatcggggtcgcaactgctgtgcgtgatatgacacagacagttgctgtgggcgtactgaatgatgaggacaaagaagcggatggccctgataaagaaagga

SEQ ID NO: 8707 - DNA, 226 bp, Homo sapiens
tgtacacgggggtgtcttgcgcatgtccatcgggaggtagggggactgggtggtagcgcgagttatacacgatgaaggcgaactggacacgttaatgtgcttggaccccatgccgatcgcgacatacgggctagctggaggagggaaacggcgatgatggggcaggatgaaggggcaaaaataggggcgtggtgagcagaaaataactgctggccttattttatgt

SEQ ID NO: 8708 - DNA, 498 bp, Homo sapiens
ttttttttttttttttttttttttttttttgggtttgaacctttaataaaagtaaaaaatgaatggaaaaagaacacaatggtgaaaacttagtatgaatgtgaacctcactagatgttcaaatctggtagagtgcaaattttggtcatactattttacatttttacaaactcaaatcactttgggtcatatattttctataaactattggcaaaaaaatcctcaaatttacattcttttggctacattatttctaacagatatagatttacttccggtttcggagagaaagacttattgtgtgtgcgtgatcaagtctggtttaaagattcactcgctgctttcatctaataacttctggtttttcataaaatgctgacatgttcaatggaaatttttgtcaaggaactggtttcattttcagaaaatatataaagggggcaatccaaagttcagaaagatgctattgttttaaaaaacaaaaatcctgtaaaaaca

SEQ ID NO: 8709 - DNA, 162 bp, Homo sapiens
  misc_feature (1)..(162): n = A, C, T or G
cgagagatgacgttccaagacatctgagcancccgcggggctatacaaccatgtaaccaaagcctcaccccttcccgcagttggaaaaaaatttatggaacaagaaaagttatcatttgaaatttaaaagggtgggcagaacattggtcccaaggaaatatt

SEQ ID NO: 8710 - DNA, 194 bp, Homo sapiens
  misc_feature (1)..(194): n = A, C, T or G
tgaagactagataggagtggnaagactggacgtatgctctgaaggagcataggagacataagtaaaagcgggcagtaaactgtcgtctgatgattatgagaccatgggaaaaagcatgagacaggtaaaacatagtaatgggcatgttacaagccactgacgtatgcctgcactattgtacagcacctttcacc

SEQ ID NO: 8711 - DNA, 162 bp, Homo sapiens
tctttttgttttatttatgttgtattgtaagatgtcaaagagtaatacgcaaggcacaaaagatcatattgttagcttgtatggttgacagagacagtgaatattatcaaggaaacatcacatctgaaggacttagcattgcaacacacaatttataagaac

SEQ ID NO: 8712 - DNA, 210 bp, Homo sapiens
gctggtgtgttatttatttgtggtacatttagaggaaagaacggtagggagccatatatgacgaagagggtaagaaggcacatgtagtaagaagaataacaagtgacacgccacagtgggtcagtggcgcaagataacgcgagatcattaactgacatggtaacaatctggtacatatcactgtgtatacatggagagaaactgacgtga

SEQ ID NO: 8713 - DNA, 178 bp, Homo sapiens
cggttgtgctgttatttttatttttgtgtattttaagaatgcaaatatctgttaaagcgagcaatatatgatcaaagaaggcgaacgaatggtaggggcaggaggtagaatcaacaaggaccactgccacttggggatcagtggcgcaaggtaacggagctagattaacctgatatgg

SEQ ID NO: 8714 - DNA, 194 bp, Homo sapiens
ggtgggcgtttatttctttaatgttaggtttaagaggaaagtagctgggatagaaggcatgcataatacagaaggctatgaatgctatggcaagaagaagggataatacgtgcgcgtgccacatgggtgttaggggtagaagataaccgtgagcagaactgtatggtatagttggtccatagtctgcttattag

SEQ ID NO: 8715 - DNA, 514 bp, Homo sapiens
caagcccccgccgcacccacctccacccccccccaaaaggaaaaacaacaaggaagaacgtacccaggcagggccaccacaaaaggggagcatcaaccgagcccacgagcgggcaaagggaaacgagcggggcggggggagacggacagggcgccagacacaccaccagcagagcacagcagacgggccgaagccgggcccgggggccggcctggacacgccccccgggcgcaggaccccccgcccatgcccccgaccccgcccgccacccacgcggccggcggaccagcacagacccccaggccacggcggggaacaaaaccagcacaacccccgaggaggcagacccacaccaccgcccccaaggagcccccccggcaggcgccggccccgaccccgccaaccggcagcccgcgggcagcgaggctccaacaggcccccccacgcgacacccaccccctacaccccccaccaagcacgcagcgaaaaaacacacgccaagggagggcaagcc

SEQ ID NO: 8716 - DNA, 306 bp, Homo sapiens
ccctttctttttttttttttttttttttttttttttttttttttttttttttttttttttttaaaataaaattaaaaaccaatgaaatttattgggttacagggaataaccgggcacaaaatggtggaaaaaggggttaaaacaagtttacattaaaaatacaaacaactacggggggtgacaaatttggaagcggggggtacttaaaaaaacggcatcgaaaaacaaaccactaaaaattcgcgaaatcaaaaaaataacttctttcttctttaaaaaaggagggggaagaagtcgttgggttat

SEQ ID NO: 8717 - DNA, 194 bp, Homo sapiens
aggtaacaaggctcttttttttttcttttttttttttttttttttacccgtttaaaaataacattttttattatttccccaggcccgatccacagccctgaaacaaaagcattctgatacacatttgtcagtgctggggggtttggttgccatgactgcctacacaggcgcgatgaacagccaccccgggttgg

SEQ ID NO: 8718 - DNA, 242 bp, Homo sapiens
tgggcaaactgactggtgatggcaagagtggtgtctatgaagacggactacacagcatggcacatacaataaacactgcgagactctatgcgattacctggctactacacacatttatacccaacataacttcatgaattgatgccaccatgtgcaataaactgcgccgtctggtgctcagaggaacaccaggcgctgcaacctgcagctctatcaggacgcccagactccgccattagggg

SEQ ID NO: 8719 - DNA, 466 bp, Homo sapiens
tgctatcacaaatattctacttgtaactattcaactgcatcgctgacataacatggttgaacgattgggataatggcactaagcactaggtgtagatatgattatgactataatacatgggtaaaggtgctgataataaaacaaactctaccatactagatacactgagtcaatgtatatataatgtgggatacgataatgaactcacaactaatatggcagggacacatatatgaaacacaatatatcctgtatttgcgatataagcatcattataagatcataagtagattgtgcgaagaatcctatgtatgccggactgttttatcctgacccaacccatatgacttgtcccagtggatccgggagaagagatatgaatgacatgtagccggactgagcctacacagttacacccccgatatgaagggaacgaaaatacatcttattgcataagctccagcag

SEQ ID NO: 8720 - DNA, 450 bp, Homo sapiens
tttttttttttttttttttttttttttttttttttttttttttttttttttttttttttttttttttttttttttatttaaaagttttattataaaaacacagggaataaaggggggaatccaggttttgggaacagaaaaaaaaaagggaaaggggaccctccccataggggacacttatccttggggtaaactaaaaaaaaaaagggaaaaaacaccaaaaacaaaaaaaaagaccaaaaaaaaaataaatttaaaaaaaaaaacaggaacggggggagggagaccggggtaggggggaaaagggggcaagggaaaaacatcaaggctaggggggcctcccctgaaaaattgcgggcttggggaagtcaaggtcggtggcagggacaaacccgtgcccggcccgcgggggggaggggaggggaagggggggggggggcggggtgaggg

SEQ ID NO: 8721 - DNA, 210 bp, Homo sapiens
tgcaaatgaatgaaaatggtttaaaatagacacaagacatgggccaacatacgttctactgacgatgcagaggaactgggaccctacccagctggactgggaatgggaggggtgccgccatgctggaaagtggcgcgggagtggcttaggatgccaagtacatccttaccatgacatacaccaacgccactgatgagatgtgcacgaagg

SEQ ID NO: 8722 - DNA, 354 bp, Homo sapiens
acaagctttttttttttttttttttttttttttgctcacatttaatttttattttgattttttttaatggtgcacaacacaatatttatttcatttggttcttttatttcattttatttgtttggtgctggtggtttatttatttttactgaaagtgagagggaacttttgggggcttttttcctttttctgtaggccggcttaagctttctaaatttggaacatctaagcaagctgaaggggaaaggggggttcgcaaaaacactcgggggaagggaaagggggctttgttaatcatgccctatggggggtgagtaactggttgggccctgccgggggcgcgggggggggcgg

SEQ ID NO: 8723 - DNA, 162 bp, Homo sapiens
gttggccccgtaggttactagtctagtgtcttcagtatgtaactactgtgacctcatgctggtcaagggtctaagtttaactagcaactatgtattccagtaaaatcagatgtaaagtatactactttggtactaggtacctaagtaggtcactttcacttg

SEQ ID NO: 8724 - DNA, 354 bp, Homo sapiens
gctgcagtgacatgagacagaacagcgcggagggcgccacaaaagcagcggacaagaaagccgcaggagcaggcaaggccaccaagccagcccagaaagcccagaaggccaaacgaacaccaccccaaacaccagccaccccacacacaaacagcggaggaagaacggtctcagaaccgcaagcatcaaccggccatacaagaagagcagcaaaagacaggacaacgacaacaacgcatcgcaaaacccccagaaggaaaggagaacgccgcgaggaccaccccggcaaccccactcgcgtgcggcagcataaagccacaagtaaccaaaaccagtacgctgccgggactgcaa

SEQ ID NO: 8725 - DNA, 578 bp, Homo sapiens
ctggtctttgtgtatggttttgtgatgtaacgatctttgctggggttttttgctttgttgtgagggaaatgtcttggagtaaatgttaagttcctggagttaatgtgttttacaggaattttgttttttaaaaaaataggatcattctgaactttggaatgacccccttatatatgatctgaaaatgaaaacagttacatgaaaaaaatatccaatgaagatgtcagcattttatgaaaaaccaaaagttattagatgaaagcagcgagtgaatctttaaaacagacttgatcacgcacacacaataagtctttctctccgaaaccggaagtgaatctatatctggtagaaataatgtagccaaaagaatgtataattgaggatttttttgccaatagtttatagaaaatatatgaaccaaagtgatatgagtttgtaaaaatgtaaaatagtatgaacaaaatttgcactctaccacatttgaacatctagtgaggggcacattcatactaaggtgtgaacaatgtgtgtctttttgcactcattttttacgttttattaaaagagcaaaaaacaaa

SEQ ID NO: 8726 - DNA, 498 bp, Homo sapiens
  misc_feature (1)..(498): n = A, C, T or G
ctgatattgtgtagacgaaaagatgatctgcaagatgataaagatctggaatatggccataaactgtagaanggtggtgaagctgtcattgctgatgatgctgccgtcgagcacatgggtgctgacgagcccatatactatgcaaccttgtgacactatgcagcttcggatatgatacatacacgtgatgtgagagacacaaaagcagtggacgagatagcagcagggagacggcaaggctgccggatctggccaggacaccaagaatgctcaaagaacattatacgctatacgaatcacatcactaataaccaccggcggaataacagtcacaggagtgagaactgcaatagaacagttaggttcaataggccaatacaggttaatgataacaaagcgtcgtatgaccacaatacagaaaagaaaatgcataatgaaacgataatgttttgtggaccacgtgtggtagctttaatgcatgaggcagtaatatcagat

SEQ ID NO: 8727 - DNA, 162 bp, Homo sapiens
aatgctcaacgcattacattacatgaactcacccatgtgatggtagtaactgttcttcatcactaaaacatggaagcgaaaaatgagtcagatgctgtttcgaggctcgaacaccatcccagcaatggtagccctgcctgcaatcttcgactttaataccca

SEQ ID NO: 8728 - DNA, 258 bp, Homo sapiens
gtagagtaggacagagacaagaaaaatataatgcacacacacattggatggttgtacttgcaaactagctaataacactagggaagaacaaaggatccaaaagcaggtggagagcataaaagaacacatgaatgggaagtcctgcaagagctacatgaatatacgagatgactctataaaagctgactaatcattatgtatatgactggaatgatcaacacacagaactacatgaaactcatccattgtaggctgatc

SEQ ID NO: 8729 - DNA, 194 bp, Homo sapiens
atggatgttaattgaataatgatggtaaaagggtagattattggttgtattttgattgatgttataatgaggaggtttgtggataggagtgaataaagtgattggatgagtgggcgaaatattatgagttgatgatgggatatatggaggatggggataagtggagaggagaagatgggaaagtggagggaaaa

SEQ ID NO: 8730 - DNA, 402 bp, Homo sapiens
gtgcaccgagacgcgcggaggcagaggctcgggtgcgtgcaagacacaactacaccggtagcaccaccgacatgagccgaagaaggcatcgtgactggacgtgtaagggaggtaaacactgcgtccacaagaggatgtgaaaactgcactaaaacacagatggcacgaccacgtgaaataagatatgatgacggacacttatacaagcgacaatggcaactccgtgtactagcatcgaagtgaggaagagacgtatgtatgaacaagacagtgctggtaggacggactgagactgaacagacactatcatactatctccaagggcgatgacgacaagaaacagggagaatgagatatgacttagttaactggacagaagggggaaaacaagtatatggtcgg

SEQ ID NO: 8731 - DNA, 498 bp, Homo sapiens
  misc_feature (1)..(498): n = A, C, G or T
tacactaaatacaaagtgacaagggtgtctgtgtgctatgctcactacaacaaacccttcacctaaaaaacaaatggaagaaaaagagaaacagctgcaaatagttaaaagcactatagtaacacataacaaaatgtgagagatgagagaatagaaagagtagaaaatataactacttgctgtgaacctatggtagttacgctctgtcagtctgtagcatacataccataccatataaacacagcacaagagtaagacaacaacacatggtgaagctagactatgtgcaggatacatgatgcgtgataacatctgcaacatgagacaaacgtagaagagaactgaggcaataaataaaagtgatacctatagacggatacagtgatataacgttgggacactgggtggaagcgcgggataggagcggtatgtgcatcactgctgagcacactaatatgaatgtagtaaatggaccacgtccagggtagatgactgnag

SEQ ID NO: 8732 - DNA, 178 bp, Homo sapiens
ctgtagtttaagatgttagacaccagactctcacgcttgatccaaacatctttactcaaccacacaacaaatgaggtaatatctgtgtgtaagtttcaccttttgtcatttaccttctcctctcggtaaaaatgtaaagaaaaaagtgtatatgcttctccttgctccactgtaaata

SEQ ID NO: 8733 - DNA, 210 bp, Homo sapiens
tgttatattagtgatagatatctattatagattgtgaatcaaaattatgaatcttcagattgatgtggttgtcgtgaatatggttcagaagatgtcgataagtagtaggactgcaagtttaggttacttatgctaggactgatgtttgtttgaatatttgtaagtgcttggttattgaaagtgattgcctttaatccaagacttatagtg

SEQ ID NO: 8734 - DNA, 338 bp, Homo sapiens
aggtactttatgaatatgccagaaatatgttacataagcaattataagacgtgcaagtatggaatggattacctcgtctccgctcaaaaacactgatctctgaaggaagatggatttatatgtggatatgcaagtctgatcataaggttcattgtgagatgatggggaacatgtaacttagttatagagctaagaggagttattgtgcagtgtggagtactcaagctttcttatctagatgtactcagtcatctggctacctcggtgcgtgaaccaatctaattattaatggattagcggccgtctggaggtcgatcatataggagaagtccgtgcgc

SEQ ID NO: 8735 - DNA, 210 bp, Homo sapiens
ggcccgggggcaaggtacctaattttggctttcatggatttacatttttttaagggggcgtttaaggtgaatttattgttatttaataatgtcctggagataactttggggtataagattccaattttaatgtaattacctactattatttttgtgttgtcgttttgcaaagaaagataatgattcctgggggcttggggaaatattaat

SEQ ID NO: 8736 - DNA, 258 bp, Homo sapiens
tacagctttttttttttttttttttttttttggttttaagttttattattgaaaaaacaaaaattcaatggtttattcatgtttttggcaaaagaaaaaaacaggggacgggggaccttcccctaagggaaaattattctttgggttaaattatattaattatgggaattgaaacttattaaattaaccgggaaattaaaaagaattaattaagaaaaagggaaaggaacgggggggaaggggtcttgatttgtggga

SEQ ID NO: 8737 - DNA, 370 bp, Homo sapiens
gtatacgtgtattatttgtttttgttttgttctgtgggaatgaagaaatattttagtaaagtgtggggagcgggatgatgttcaatctcacaacttttggaaatgcttcttggtgctgtcagccgttggtgatctttatcttatttaaatgcactgtattgtgcagaggtctggtctcgcgtgttgtgaccattatttatatctggatatccctaagataggtggacaggtgtgcgtgtggtggcggtcgctctatctctgttgtggattatacgtcggatgcagatgagatatatgggtgtgctcataatgcgttggatgcataacatgagtattatataatgtaaacaaaatagcttggggtcggtat

SEQ ID NO: 8738 - DNA, 386 bp, Homo sapiens
actgcacactgatctgtaactcatcgcatgttgttattttgttttatcttcataccaggtcatattatctttatgaacagactggtgtatctactaaaaaatatatttatttctgagagctatgtttttggctgggaggagtgatatctcttcatacttaaatgttttattatatgcttaattattgtattctgggtgtttggttgtatgtacttgctgcgaggtggtgctgagatgtcactactgggtgcgccgctgcatgtcagtcgaacatatgggagagcttgcaagtcgtcggttggatagctctactattctatagtgtgaatataatagctgtctataatcgtggtcttaattgtttgctgttgtgatattgttttcct

SEQ ID NO: 8739 - DNA, 258 bp, Homo sapiens
tggcgcctcgggtagtgatccatgagaaagccatgtcagttcgaacgatagatcgttaagactcatgagagaaactgacgagtttaatctgaatctcctagttctttggagatggagatgaatcgtgaatacagctgagatctagtagatattattaggtagcaaatgaaattgtagttggtggtggttggaatgctataataatctttgttctccgtgtctcagttgaaatctttacacaaattataaggctgggtg

SEQ ID NO: 8740 - DNA, 386 bp, Homo sapiens
aggtaggagcattgtgcccattatttcttatggtcgatagagggttcagggggtgctaatacggtatataccggccgtatcttcatgatggctaaggaaagttatttgaggaatatcgagcatgaacgtgtgttttgttggggagatactgtaccattgagtgtattttactgacgcggctgtgttctgatgaaagtggttgggtatttacgtcttggaaaagtgtttgtctttcaatctgatgtgttgccagctcatatgtgcgaggtgttgtgctatgtgttcattatcagaatgggggtttccatatgccatatctgacgtggtggcctgtctatatcaatgaatgtgtcgcagctgaatgacacgttgaaaatattggagag

SEQ ID NO: 8741 - DNA, 386 bp, Homo sapiens
aaatgtttgatctgttattgaattgatctgtacagagtcatgatatttttttggtatgtatgagtaacatgaatgcttctgtatgaaacagttgttatatatactctagatttatatactaacattctggtttggctatttatgtgatattgatggtgttatatattatagtattatgtgttcattccataaattttatgaatataaattcattgatttctgtcttctatggtgatggtgggtgactagtgtttggatggagtctaatattaaatgattgtagcgattgattatgtatggaattaatatctatctcatataagacgcaaaaaaaacaaggaaagaataataccaaatgtagtggaggaagagggagggaacgaaag

SEQ ID NO: 8742 - DNA, 322 bp, Homo sapiens
gtacaagcttttttttttttttttttttttttggtttaaaatttttttattaaaaaaaaaaaaattcaatttttttatcaatttttttgcaacatataaaaatcatggacgttgaaccatcccaatagggaaatcttttctttgggttaaattattttaattatgggaaatgatatttattacaataacaaggaatttaaaaaaatataattaaaaaaaagggataggaattggggaaaggattctttattttggaggaattgtgtctcttgtaaaagcatccgggttcaggcaaccttccttgaaaatttcttgtttctaa

SEQ ID NO: 8743 - DNA, 386 bp, Homo sapiens
taggtatcgtgtgtggcgctgacgtcctcctctgaagcatgggatctctgatttgctaggtcctggttgcttcagttgcctgattagtctccgaggccgtgttagcagtcagtagatgtccgtactagatcctgtgaggtagggtggtgggtactgggagatgagtagatagagatgccagtaacatgttgtcttcctaaacaagagaggtcgggaggtatgtgtgtgggggaagtgaggagtgggtccagaaatatgtcagagagctggtgttgagtgactgatgggtataaagatgtaggtgtaagactcagggtgtcagtggggaggagcacgagcctgagctcgtggggagcatgacgtgatgatcgtcgtaggagacgtta

SEQ ID NO: 8744 - DNA, 594 bp, Homo sapiens
ggtactgattttggatttttgattttttttttgggtgtgaacttatacttgattgatatatatcatatatagataatttgaacatatgatttactatccattgtgggttgatgtatagattgtcaacttatatttggaatgtaataagtatgtattcttctgttaatgctatgttctcctggtgttcatctgacacatggaatttgtgtctgatgtgccattagagcggtgtctcatattgtccgcatatcttgatcgaggtagtgaattggatcgtatcttttgatttataagtgttcattgtatgattctgtgagttatacataccacggatgggatgttgcttatgttggctgcctatttggtctgtgagattgagcgtttttatcacatacatttgcctaatttgtcataatacaatggattagatgacacctctgtcgcgaacattcttatctgtattgtattcgtggtggacttcacgtcgaatatgtgggagatctcctatcgcgatgagatgtgtagcttgatgttgctatagcggtccctaaatggctcgacgtcatcattatcatggttgtttccagggtgtag

SEQ ID NO: 8745 - DNA, 514 bp, Homo sapiens
gcaggtactgattatggagtcaatgaatatatggaagggtcattcatgatatatgatgtaggatggtatgttttcatatggatcaacgtagaatcattcaagttatgtatggtatgctgtgtatacaatggctcatatagtgagatgatatctataaatgtatatgctgaataatattactttatgtttttatgtacattgtttgattaggtgaaataagtacataacgcatgggatcttgcgtaggtcggctgtctagatggactctgacataaagtcttgttttcggatagcatagattgattagtggcatctaataggattatctgagacagtcaggggatataggattcataaatcatacttgtatctagtcatatgcatgcttatctacacaaaagtagatattatatatacttatctgattgatgagatctctcatatctctcccatatttattatgttgtatatcaatttatggatttttatctggaatttgaagatagcacgttcg

SEQ ID NO: 8746 - DNA, 306 bp, Homo sapiens
agtgattatggaaacatgaagctatttaagggtttattacccctaaaggaatggaaagtaatctataatatggataaaagacatttattaaaaaaaataattgttgtctgtgtatagaaaagcagcttacaatgaatatgttatcaataaatatctatgcttagaaagtgcaaccttcttggtcttataaacaaaaagtgggcattggttatcctttgataacttacggccagggggttcattaggaaatccaccccatcatgatggaagtttggcggccccatcttccgttatggttaaaaaaaa

SEQ ID NO: 8747 - DNA, 430 bp, Homo sapiens
aggagttcatcagcggtcagtctgtggtgtttgtggccattgccttcatcaccatgatgattatctcgttagcctggctaatattttactatatacagcgtttcctatatactggctctcagattggaagtcagagccatagaaaagaaactaagaaagttattggccagcttctacttcatactgtaaagcatggagaaaagggaattgatgttgatgctgaaaattgtgcagtgtgtattgaaaatttcaaagtaaaggatattattagaattctgccaatgcagcatatttttcatagaatatgcattgacccatggcttgtggatcaccgaacatgtccaatgtgtaaacttgatgtcatcaaagccctaggatatgggggagagcctggggatgtacctcggccggcgacacgctaatgactagt

SEQ ID NO: 8748 - DNA, 178 bp, Homo sapiens
cagtcagtttacgagtgtttctagattaggttgtataatttatgatggattggcagaggtgcatacattaaatgtaacttgttttttgtcctctcccattatacataatggagtgatgatatactgaatgtgtgggaagaataatgaaagagattgaatttctacatctagtgcatca

SEQ ID NO: 8749 - DNA, 194 bp, Homo sapiens
tactaataatggtgttggcttagctatgatggattcaacatgaaaaatgtgaagctgtgataggtcattgtaatgtaaaatttgttaagacaacaacatcagtttttgggcggatatgatatttattgtgtaaatttgctgatggaggacaggaccagagacagaatcagcaatatacatgctatagggaagga

SEQ ID NO: 8750 - DNA, 402 bp, Homo sapiens
aggtgcatgctggatgataggatgaatttgaatgaatggtatctcctgagaatgggcagacactagaacatgaccttctggacttacagactggcgatgtgaatacaaaataatgtgtcgagatgtgatcgacaatggtattccactgaggggtactacagtcagacaagatatgacgaagatgtgtgagggagtggggaggaagatgagaaagtagtggtattatccgaacacagtagaattggtgcaatttgctgatatgaaatggtggatacatgctagattcaagtgtgatgagaattggtactagggatggaaagtcactgctaagattgcaagtgagtgagagtggtgagccagatgctctggactgcgtcataacatggacttgtgcaaatgata

SEQ ID NO: 8751 - DNA, 162 bp, Homo sapiens
cagaattatataatactaatgcgtatgtgatgtgagacggtagctgctgtcagacggcatcactgtgaattcagatgcaaagaggaactgttgatcttgatgcccatacctctgatcagaatcttgacatactgtcatgagacactatagggtacgttatca

SEQ ID NO: 8752 - DNA, 194 bp, Homo sapiens
agataactatgggttaaaagagagagtggattttttatacatgattggatacagtgggattgaccatcagctgactaggagataatataacaggctgttgaaagtgattgttttttgaagatagaggatatgagattttctgctgatcttataatggtgtgatgtctgatatcttgtgttcgctgttattgtta

SEQ ID NO: 8753 - DNA, 162 bp, Homo sapiens
acacactgccactggcttttgctgtccacggccatgacagaccgacgcagcgagctttctctcaaaagcaatgcttaaattttattcataatatactgactgcaacaacatcatgaaaatacaaaaaaaaaaaaaaaaaagacttgtacatgaacagaggcg

SEQ ID NO: 8754 - DNA, 466 bp, Homo sapiens
ggtcatacaaagagggcactacaccagcttcttggcctcaaagaagctcttgaggtgacgcatctgccagatgccagtgaggatgaggatgacagtctgagcaatggaccaccataggtacctctggttggtgctctcgctcgtcagtcggaagcgctcttcacgatacctttggtaatcctgctccttctgaatctgttccacctgatcaagcaactggcgggagcggagctgtagctccgacagattatcttttgaagaaatctcagggtagtagtaggaatgctccccaaactggatgtagagatgacaccgaagtttgacaacagagaagagagccatcctgatagaataggagtgaagacagatatgatggtcaccgggagtgtgggaggtgaaagtgaagaggaactcagagcagataatgaccgggaggaagaacgaaataaatagagaataagaagac

SEQ ID NO: 8755 - DNA, 496 bp, Homo sapiens
gagtgagcctcctcacccctctctgctctgctgatgggggcttttggacagcaaggcatagagcagaaaacgtgaacactgctacccctggtgaaaaactgtgtgaccttgagcaagtcggtctcgctcagtctctttcctcagctggggataaaattcctacttcacaggactgtaaagattaagcaaggcaagggatatgaaagtgcttagcacataataggggaacaatatatcctgtatctgagtatggataggagtgtggagatcatccaggttgagagggagaagagtggattaaagacagtcagtgggattaagtgtctaccctgaccttgcttctctacatttccttttcatcttgaaagaagttggaggtggcaaaaatattaagaaggtggatcagaatgacttggggactgaaatttgtgagggaagagacaggctgtgcaccttctagaatggatttatctcttttatgactaccaagaaggga

SEQ ID NO: 8756 - DNA, 258 bp, Homo sapiens
cataggtgcttactatactgttttgtttctgaatttggaatttctcaaaattaaaaaaatatctactgaggagcttttcgttttaactggtggggaatgggttctgggtggttttgccccttgtttttttagattcaagaaatccatggtgaaaggtttggtattctatgaagaataggaggataaagtgatcaaggagatggcagctcagatgcgcgaggtggagcagagccgacaggaagtgggcgtgtccgctct

SEQ ID NO: 8757 - DNA, 551 bp, Homo sapiens
  misc_feature (1)..(551): n = A, C, T or G
aggtacacattgccatgagatggcactttctgaggatactcactaaaactgagtttcttcattagaaaaatctcactttttatcatcatctcagtgcctggtattggtgcccttangtctgtgaacagcattgcgttatgccagtaaatgaatacttaaatcaataattgcattctcagcagtcctcttagtctttgtttgtttgtttgtttttcacagttgaattgcaatgtagctgtttggcagaggcattaacatttttgccctaaccctggcctggtgcctangctcaggggagtaaaattagagccaggagccagngagctgaggagaccacttaaaaggcatgctagcatttgataagtaaggggttactttgtgaggaaaagaaactttatatgctttaagcaagcctctttatgaggaagaaaaggtcagctactgaagcggggtcccaactactgctgggtctgtagaggagagagacacccccaaaatccagatgttttagttaacaatcagacacagacttgtctctggtttcttacagg

SEQ ID NO: 8758 - DNA, 466 bp, Homo sapiens
  misc_feature (1)..(466): n = A, C, T or G
cgggncagnntacatggntgnantggagncctnncctccacccctctctggctctgnctgnnatgggggncttttggnacagccaaggncataggancaggaaaacgtgaacactgctacccctggtgaaaaactgtgtgaccttgagcaagtcggtctcgctcagtctctttcctcagctggggataaaattcctacttcacaggactgtaaagattaagcaaggcaagggatatgaaagtgcttagcacataataggggaacaatatatcctgtatctgagtatggataggagtggggagaatatccaggttgagagggagaaaaatggattaaaggacaagcagggggattaaatgtttaacctgaccttggttgtgtatattttgttttgaattagaaagaaattggtggtgggaaaaatattaggaagggtgaacagaaagacatgggggcaggcatatgt

SEQ ID NO: 8759 - DNA, 450 bp, Homo sapiens
tgatttctaaagtaagcctcagaatttccaaaccaattcatccacagctgtttctgggctggttttaaagtagctgctacagaatcatgaggctttccctttttatcaaatacgaaaaacatttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctgggggctcactttctcccaggattgtgggcttctctggaagtgaagggtgaggaatgagtggggtgtcgagcccagccctggctgcctgtgggtttgggggagggagcgagggatgaggtgccctggcagatggca

SEQ ID NO: 8760 - DNA, 530 bp, Homo sapiens
gcagcttccccgagctgatgccattcgttcacgtctcatcgatactttctctctcatcgagcatttgcaaggcttgagccaagctgtgctgcgacacactatcaggagttacttgatccttcccgccagaagaaacttatgttgggagatcaacaccagctagtgggcgtctctataaagcctcaacgtatagaacagatttcacatgcccagaggctgttgagcaggcttcatgtgcgctgcagtcagaggccacctctttctttgtgggccggatgggtccttgagtgtatcctttcatgtcactcatttttatcctggctgttgatcatctgcctaatgaattattttttgcttcccaaactccattgtctcattctcaatgcttatgttattgctcttattatttccgctgcataaatcagaaagaactcaaaaaaaaaaaaaaaaaaaaaattggggggcggaagcttattccctttagtgaaggttaattaaagcttgggactggccggaggtgtacaaagtcg

SEQ ID NO: 8761 - DNA, 690 bp, Homo sapiens
  misc_feature (1)..(690): n = A, C, T or G
taagcgtgtccagaattggtgggtctcactgacttcaagaatgaagccgcggaccctcctggcggaattctccacgagttttgagcagcctcggttttcccaccacctccaaatcatgcaagacacagggtaagagcaaagacaatgtggctgtggccgatgtccaccctctcggggcgtcccttctcttctctcctccttgagcagggagaccatcggggtgcaacctggttggggcggggaggaggtgcagggcctggccagagcgggcctggccacgggcaagggacagcgacccccgggccaggacaggtgagagcggcgcaggcccgggcccggcgtggcggaggtgcgcgtgagcggncagcagagggcgccagagagccaggagcggcccgcagaggagcccgcgccggccccggtgcccacctccgcgccgcgcggaccctccgagcccgcgctcagacgccccagctccgccgagagggcgcttgcgccgggtccttctcccccaaatgcaggcagagcccccggagccatgggcaggccttccggcagctccaaagccactggcaagccccgaaggcaggatggccggcccaggagggaggaggacgacgtcccctcccgaagagaagaagctgcggctcttgctggtaggggggaagcgcacagccccaggaactggaa

SEQ ID NO: 8762 - DNA, 418 bp, Homo sapiens
atagattttcaaaatgtctaaaaagtgcagtttgaattgttacatgttaatacacagttgctttattcagatgtgtttgtgttgacggactaacagtgccttctggatctgtgcaaataatggtacccctccctgcaaagaaaaaaagagtcattaaagcactacaatattacacataaactgatccatctaggtcagctttagtcaggaccggagaatcagcaaacataagaaaaacaaaacctaggaatacatacaaaagctctcatggggtgctagaaccctcttagactggtgatgtatgtggagggcattaagagctggaaaggcgtatatgggtaactaccgttaactatattctacagcaagggctgggggggcagaacaaggtgaaggtgggtggttattagggttggga

SEQ ID NO: 8763 - DNA, 632 bp, Homo sapiens
aatgaatgaaaataaagttttacctcccaagtcaatttcacataattctaattccttttaactagagaatatcttgtttagaaggatcattaagctaggtcaaggtaaaaaacaggttataagacaaatgcatatgaaatctacaacttataaggaaagaaaataccaaattagttctatcagtcctctaaactacagaagaacattatttttacctagtgtgcatgtacacacacacacacacacacacacacaaatatttaatgcttttaagtacatttttaaaaaaaatctaaacaatactttgactagtcttttcctcctaatattatatatagactgaagtttttgaaaataaaagtagctgagccaatgaaatgctttagcattgtatttttaccatcaagcactgtttagcaggctgtatttcccacttttcttcattgatatcaggagcaagcactagaaatatagaaaataaatataaaataatcacaagttcttaaccttatttttttcagtctttatcagcttcacgtagagagctgctcactgtgttatagcactttttaagttgcaaagccttgtcatatacattataatttgtattcctctaagcaagtcaaggggcg

SEQ ID NO: 8764 - DNA, 450 bp, Homo sapiens
tgcagacctcggaagggagcggatagcggcacccggagccgcccgcagagcaaagcgcggggaaccaaggagacgctcctggcactgcagataacttgtctgcatttcaagaacaaactaccagagaccttacctgttcacttggctctcccaaccaatggagatggctccaatggtggcacaaaccagggaagggaaatctgaggtttaattcctttatgcctcattctctgagtgctgaaggcttgctgtaggcctgtatgcctgttaaatgctaaattgtgataggggtttttgccttccaatgaactcccacatatttacattttaccagtgtatgatgccctgttactagcattgacatgggaacaaaattgctgccggggggaggatgaacaaagaaagtcatgaagttaccccttgtctgggataaaactatagtactttcaa

SEQ ID NO: 8765 - DNA, 562 bp, Homo sapiens
  misc_feature (1)..(562): n = A, C, T or G
ggggtaccattttacacacctccgncggtggnaaatccttgnaaagnaaagcagcaccagctgctgactgcaggcctctctgccacctctgcctgcccgcctcactgactgcttcatctgccagcctcgcatgcacttctgacaacacacctgtccatcacagacactgccagctgctctgtgtgtatccatgtgtgtgagccagtggtgctggcgggcagcggaacgatcgtccgtgatgctagaccgaacatgcacgggcacgcatctcctggcgtgtgagtggaggctgtcagaggggcggacgggagtgagggcatgtgtctgcatgggactgatagggacagagaaacagtggcagacttgggcgatacatagctcaccagacaaacatgcaccgtcagatagatagagggtagaaagatcagggagaagagagagcccagcaaacatgcacaccangcagtggcgggagaggcacgctcactacataggaagaatgaacagacggcacacgcacgcagggcatggactgcagcacatctaaccaaccatgcctaga

SEQ ID NO: 8766 - DNA, 594 bp, Homo sapiens
  misc_feature (1)..(594): n = A, C, G or T
cattgccatgagatggcactttctgaggatactcactaaaactgagtttcttcattagaaaaatctcactttttatcatcatctcagtgcctggtattggtgcccttangtctgtgaacagcattgcgttatgccagtaaatgaatacttaaatcaataattgcattctcagcagtcctcttagtctttgtttgtttgtttgtttttcacagttgaattgcaatgtagctgtttggcagaggcattaacatttttgccctaaccctggcctggtgcctangctcnagggagtaaaattagagccaggagccaggangctgaggagaccacttaaaaggcatgctagcatttgataagtaaggggttactttgtgaggaaaagaaacttttatatgctttangcaagcctctttatgangaagaaaaagtcagctactgaacggggtcccaactactgctgggtttgtagaggagagagacacccccataatccagaggttcagttaacaatcagacacagacttgtctctggtttcttacagggtgacagcagtattcgctattttgagatcaccgatgaaaaccccggcaccc

SEQ ID NO: 8767 - DNA, 754 bp, Homo sapiens
  misc_feature (1)..(754): n = A , C, T or G
actatatttaggcaccactgccataaactaccaaaaaaaaaatgtaattcctagaagctgtgaagaatagtagtgtagctaagcacggtgtgtggacagtgggacatctgccacctgcagtaggtctctgcactcccaaaagcaaattacattggcttgaacttcagtatgcccggttccaccctccagaaacttttgtgttctttgtatagaatttaggaacttctgagggccacaaatacacacattaaaaaaggtagaatttttgaagataagattcttctaaaaaagcttcccaatgcttgagtagaaagtatcagtagaggtatcaagggaggagagactaggtgaccactaaactccttcagactcttaaaattacgattcttttctcaaaggggaagaacgtcagtgcagcgatcccttcacctttagctaaagaattggactgtgctgctcaaaataaagatcagttggaggtangatgtccaagactgaaggtaaaggactagtgcaaactgaaagtgatggggaaacagacctacgtatggaagccatgtagtgttcttcacaggctgctgttgactgaaattcctatcctcaaattactctagactgaagctgcttcccttcagtgagcagcctctccttccaagattctggaaagcacacctgactccaaacaaagacttagagccctgtgtcagtgctgctgctgcttttaccagattctctaaccttccgggtagaagag

SEQ ID NO: 8768 - protein, 730 aa, Homo sapiens [sequence omitted]

SEQ ID NO: 8769 - DNA, 674 bp, Homo sapiens
  misc_feature (201)..(201): n = A, C, G or T
  misc_feature (477)..(538): masked repetitive sequence
taaaagcaggctgtgcactagggacctagtgaccttactagaaaaaactcaaattctctgagccacaagtcctcatgggcaaaatgtagataccaccacctaaccctgccaatttcctatcattgtgactatcaaattaaaccacaggcaggaagttgccttgaaaactttttatagtgtatattactgttcacatagatnagcaattaactttacatatacccgtttttaaaagatcagtcctgtgattaaaagtctggctgccctaattcacttcgattatacattaggttaaagccatataaaagaggcactacgtcttcggagagatgaatggatattacaagcagtaatgttggctttggaatatacacataatgtccacttgacctcatctatttgacacaaaatgtaaactaaattatgagcatcattagataccttggccttttcaaatcacacagggtcctagatctnnnnnnnnnnnnnnnnnnnnnnnnnnnnnnnnnnnnnnnnnnnnnnnnnnnnnnnnnnnnnnactttgggattcctatatctttgtcagctgtcaacttcagtgttttcaggttaaattctatccatagtcatcccaatatacctgctttagatgatacaaccttcaaaagatccgctcttcctcgtaaaaagtggag

SEQ ID NO: 8770 - DNA, 1010 bp, Homo sapiens
  misc_feature (1)..(1010): n = A, C, T or G
cggacaggtacctaaaagcaggctgtgcactagggacctagtgaccttactagaaaaaactcaaattctctgagccacaagtcctcatgggcaaaatgtagataccaccacctaaccctgccaatttcctatcattgtgactatcaaattaaaccacaggcaggaagttgccttgaaaactttttatagtgtatattactgttcacatagatnagcaattaactttacatatacccgtttttaaaagatcagtcctgtgattaaaagtctggctgccctaattcacttcgattatacattaggttaaagccatataaaagaggcactacgtcttcggagagatgaatggatattacaagcagtaattttggctttggaatatacacataatgtccacttgacctcatctatttgacacaaaatgtaaactaaattatgagcatcattagataccttgggccttttcaaatcacacagggtcctagatctgnnnnnnnnnnnnnnnnnnnnnnnnnnnnnnnnnnnnnnnnnnnnnnnnnnnnnnnnnnnnnactttggattcttatatctttgtcagctgtcaacttcagtgttttcaggntaaattctatccatagtcatcccaatatacctgctttagatgatacaaacttcaaaagatccggctctccctcgtaaaacgtggaggacagacatcaagggggttttctgagtaaagaaaggcaaccgctcggcaaaaactcaccctggcacaacaggancgaatatatacagacgctgattgagcgttttgctccatcttcacttctgttaaatgaagacattgatatctaaaatgctatgagtctaactttgtaaaattaaaatagatttgtagttatttttcaaaatgaaatcgaaaagatacaagttttgaaggcagtctctttttccaccctgcccctctagtgtgttttacacacttctctggccactccaacagggaagctggtccagggccattatacagg

SEQ ID NO: 8771 - DNA, 21 bp, Human cytomegalovirus
atgtggccgcttctgaaaaac

SEQ ID NO: 8772 - DNA, 19 bp, Human cytomegalovirus
tcatggggtggggacgggg

SEQ ID NO: 8773 - DNA, 20 bp, Human cytomegalovirus
gtacgcgctgctgggtcatg

SEQ ID NO: 8774 - DNA, 21 bp, Human cytomegalovirus
tcataccccgctgaggttatg

SEQ ID NO: 8775 - DNA, 20 bp, Human cytomegalovirus
cacggacgacgacgctgacg

SEQ ID NO: 8776 - DNA, 21 bp, Human cytomegalovirus
gtacggcagaaaagccggctc

SEQ ID NO: 8777 - DNA, 22 bp, Human cytomegalovirus
caccaaagacacgtcgttacag

SEQ ID NO: 8778 - DNA, 22 bp, Human cytomegalovirus
tcagacgttctcttcttcgtcg

SEQ ID NO: 8779 - DNA, 21 bp, Human cytomegalovirus
cagcggcgctcaacatttcac

SEQ ID NO: 8780 - DNA, 22 bp, Human cytomegalovirus
tcagcatgtcttgagcatgcgg

SEQ ID NO: 8781 - DNA, 21 bp, Human cytomegalovirus
cctccccaactactactaccg

SEQ ID NO: 8782 - DNA, 23 bp, Human cytomegalovirus
ttactcgagcttattgagcgcag

SEQ ID NO: 8783 - DNA, 20 bp, Human cytomegalovirus
cacgtcgggcgttatgacac

SEQ ID NO: 8784 - DNA, 21 bp, Human cytomegalovirus
tcaacctcggtgctttttggg

SEQ ID NO: 8785 - DNA, 20 bp, Human cytomegalovirus
ctgtctgctcattctggcgg

SEQ ID NO: 8786 - DNA, 21 bp, Human cytomegalovirus
ttactcggggaacagttggcg

SEQ ID NO: 8787 - DNA, 20 bp, Human cytomegalovirus
atgatgaccgaccgcacgga

SEQ ID NO: 8788 - DNA, 21 bp, Human cytomegalovirus
tcacggtggctcgatacactg

SEQ ID NO: 8789 - DNA, 23 bp, Human cytomegalovirus
aagcttccttacagcataactgt

SEQ ID NO: 8790 - DNA, 27 bp, Human cytomegalovirus
ccttataacatgtattttgaaaaattg

SEQ ID NO: 8791 - DNA, 21 bp, Human cytomegalovirus
atgatacacgactaccactgg

SEQ ID NO: 8792 - DNA, 22 bp, Human cytomegalovirus
ttacgagcaagagttcatcacg

SEQ ID NO: 8793 - DNA, 19 bp, Human cytomegalovirus
ctgcgtgtcctcgctgggt

SEQ ID NO: 8794 - DNA, 21 bp, Human cytomegalovirus
tcacgagtccactcggaaagc

SEQ ID NO: 8795 - DNA, 20 bp, Human cytomegalovirus
ctcgtcttcttcggctccac

SEQ ID NO: 8796 - DNA, 22 bp, Human cytomegalovirus
ttaatcgtcgaaaaacgccgcg

SEQ ID NO: 8797 - DNA, 21 bp, Human cytomegalovirus
gatgcttgtaacgaaggcgtc

SEQ ID NO: 8798 - DNA, 22 bp, Human cytomegalovirus
ttactgagacttgttcctcagg

SEQ ID NO: 8799 - DNA, 21 bp, Human cytomegalovirus
gtagcctacactttggccacc

SEQ ID NO: 8800 - DNA, 22 bp, Human cytomegalovirus
ttactggtcagccttgcttcta

SEQ ID NO: 8801 - DNA, 18 bp, Human cytomegalovirus
acgtccctggtagacggg

SEQ ID NO: 8802 - DNA, 24 bp, Human cytomegalovirus
ttataagaaaagaagcacaagctc

SEQ ID NO: 8803 - DNA, 28 bp, Human cytomegalovirus
atgtattgttttctttttttacagaaag

SEQ ID NO: 8804 - DNA, 27 bp, Human cytomegalovirus
ttatattattatcaaaacgaaaaacag

SEQ ID NO: 8805 - DNA, 22 bp, Human cytomegalovirus
cttctcctttccttaatctcgg

SEQ ID NO: 8806 - DNA, 20 bp, Human cytomegalovirus
ctatacggagatcgcggtcc

SEQ ID NO: 8807 - DNA, 22 bp, Human cytomegalovirus
atgcatacatacacgcgtgcat

SEQ ID NO: 8808 - DNA, 22 bp, Human cytomegalovirus
ctaccatataaaaacgcagggg

SEQ ID NO: 8809 - DNA, 20 bp, Human cytomegalovirus
atgaaagcaagaggcagccg

SEQ ID NO: 8810 - DNA, 23 bp, Human cytomegalovirus
tcataaggtaacgatgctacttt

SEQ ID NO: 8811 - DNA, 21 bp, Human cytomegalovirus
atggactggcgatttacggtt

SEQ ID NO: 8812 - DNA, 22 bp, Human cytomegalovirus
ctacattgtgccatttctcagt

SEQ ID NO: 8813 - DNA, 23 bp, Human cytomegalovirus
atgaacaatctctggaaagcctg

SEQ ID NO: 8814 - DNA, 22 bp, Human cytomegalovirus
tcagcacacgaaaaaccgcatc

SEQ ID NO: 8815 - DNA, 21 bp, Human cytomegalovirus
atgaagccggtgttggtgctc

SEQ ID NO: 8816 - DNA, 22 bp, Human cytomegalovirus
ttaaataaatcgcagacgggcg

SEQ ID NO: 8817 - DNA, 22 bp, Human cytomegalovirus
atggatctcttgattcgtctcg

SEQ ID NO: 8818 - DNA, 22 bp, Human cytomegalovirus
tcaggagccacaacgtcgaatc

SEQ ID NO: 8819 - DNA, 20 bp, Human cytomegalovirus
cgcaaaacgctactggctcc

SEQ ID NO: 8820 - DNA, 22 bp, Human cytomegalovirus
tcaccactggtccgaaaacatc

SEQ ID NO: 8821 - DNA, 20 bp, Human cytomegalovirus
tacggctggtccgtcatcgt

SEQ ID NO: 8822 - DNA, 22 bp, Human cytomegalovirus
ttacaacaagctgaggagactc

SEQ ID NO: 8823 - DNA, 26 bp, Human cytomegalovirus
atgaccacctctacaaataatcaaac

SEQ ID NO: 8824 - DNA, 22 bp, Human cytomegalovirus
gtagaaacaagcgttgagtccc

SEQ ID NO: 8825 - DNA, 19 bp, Human cytomegalovirus
cgttgcggtgtctcagtcg

SEQ ID NO: 8826 - DNA, 21 bp, Human cytomegalovirus
tcatgctgtggtaccaggata

SEQ ID NO: 8827 - DNA, 5252 bp, Homo sapiens
ctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatatgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcttgccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagttccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctggatccatgggcatacctgtgttcgaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttggttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggaactctgtgtatgaatcctgattttaactgctaggattcagctaaatttctgagctttatgatctgtggaaatttggaatgaaatcgaattcattttgtacatacatagtatattaaaactatataatagttcatagaaatgttcagtaatgaaaaaatatatccaatcagagccatcccgaaaaaaaaaaaaaaa

SEQ ID NO: 8828 - DNA, 5252 bp, Homo sapiens
  misc_feature (3967)..(3988): Masked repetitive sequence from Repeat Masker
ctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatatgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacnnnnnnnnnnnnnnnnnnnnnngtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcttgccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagttccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctggatccatgggcatacctgtgttcgaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttggttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggaactctgtgtatgaatcctgattttaactgctaggattcagctaaatttctgagctttatgatctgtggaaatttggaatgaaatcgaattcattttgtacatacatagtatattaaaactatataatagttcatagaaatgttcagtaatgaaaaaatatatccaatcagagccatcccgaaaaaaaaaaaaaaa

SEQ ID NO: 8829 - DNA, 841 bp, Homo sapiens
ttttttttttttttcttaaatagcatttattttctctcaaaaagcctattatgtactaacaagtgttcctctaaattagaaaggcatcactactaaaattttatacatattttttatataagagaaggaatattgggttacaatctgaatttctctttatgatttctcttaaagtatagaacagctattaaaatgactaatattgctaaaatgaaggctactaaatttccccaagaatttcggtggaatgcccaaaaatggtgttaagatatgcagaagggcccatttcaagcaaagcaatctctccaccccttcataaaagatttaagctaaaaaaaaaaaaaaaagaagaaaatccaacagctgaagacattgggctatttataaatcttctcccagtcccccagacagcctcacatgggggctgtaaacagctaactaaaatatctttgagactcttatgtccacacccactgacacaaggagagctgtaaccacagtgaaactagactttgctttcctttagcaagtatgtgcctatgatagtaaactggagtaaatgtaacagtaataaaacaaattttttttaaaaataaaaattatacctttttctccaacaaacggtaaagaccacgtgaagacatccataaaattaggcaaccagtaaagatgtggagaaccagtaaactgtcgaaattcatcacattattttcatactttaatacagcagctttaattattggagaacatcaaagtaattaggtgccgaaaaacattgttattaatgaagggaacccctgacgtttgaccttttctgtaccatctatagccctggacttga

SEQ ID NO: 8830 - DNA, 841 bp, Homo sapiens
  misc_feature (94)..(121): Masked repetitive sequence
  misc_feature (569)..(604): Masked repetitive sequence
ttttttttttttttcttaaatagcatttattttctctcaaaaagcctattatgtactaacaagtgttcctctaaattagaaaggcatcactacnnnnnnnnnnnnnnnnnnnnnnnnnnnngagaaggaatattgggttacaatctgaatttctctttatgatttctcttaaagtatagaacagctattaaaatgactaatattgctaaaatgaaggctactaaatttccccaagaatttcggtggaatgcccaaaaatggtgttaagatatgcagaagggcccatttcaagcaaagcaatctctccaccccttcataaaagatttaagctaaaaaaaaaaaaaaaagaagaaaatccaacagctgaagacattgggctatttataaatcttctcccagtcccccagacagcctcacatgggggctgtaaacagctaactaaaatatctttgagactcttatgtccacacccactgacacaaggagagctgtaaccacagtgaaactagactttgctttcctttagcaagtatgtgcctatgatagtaaactggagtaaatgtaacagnnnnnnnnnnnnnnnnnnnnnnnnnnnnnnnnnnnncctttttctccaacaaacggtaaagaccacgtgaagacatccataaaattaggcaaccagtaaagatgtggagaaccagtaaactgtcgaaattcatcacattattttcatactttaatacagcagctttaattattggagaacatcaaagtaattaggtgccgaaaaacattgttattaatgaagggaacccctgacgtttgaccttttctgtaccatctatagccctggacttga

SEQ ID NO: 8831 - DNA, 63 bp, Artificial Sequence
  T7T24 Primer
ggccagtgaattgtaatacgactcactatagggaggcggtttttttttttttttttttttttt

SEQ ID NO: 8832 - DNA, 1010 bp, Homo sapiens; identical to SEQ ID NO: 8770
  misc_feature (213)..(213): n = A, C, G or T
  misc_feature (491)..(551): masked repetitive sequence
  misc_feature (601)..(601): n = A, C, G or T
  misc_feature (761)..(761): n = A, C, G or T

SEQ ID NO: 8833 - DNA, 463 bp, Artificial Sequence
  Primer
ttggcttgactcaggatttaaaaactggaacggtgaaggtgacagcagtcggttggacgagcatcccccaaagttcacaatgtggccgaggactttgattgcacattgttgttttttaatagtcattccaaatatgagatgcattgttacaggaagtcccttgccatcctaaaagcaccccacttctctctaaggagaatggcccagtcctctcccaagtccacacaggggagggatagcattgctttcgtgtaaattatgtaatgcaaaatttttttaatcttcgccttaatcttttttattttgttttattttgaatgatgagccttcgtgcccccccttcccccttttttcccccaacttgagatgtatgaaggcttttggtctccctgggagtgggtggaggcagccgggcttacctgtacactgacttgagaccagttgaataaaagtgcacacctta

SEQ ID NO: 8834 - DNA, 491 bp, Artificial Sequence
  Primer
gaagagtaccagaaaagtctgctagagcagtaccatctgggtctggatcaaaaacgcagaaaatatgtggttggagagctcatttggaattttgccgatttcatgactgaacagtcaccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcccgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtcgctactg

SEQ ID NO: 8835 - DNA, 20 bp, Artificial Sequence
  Primer
cacaatgtggccgaggactt

SEQ ID NO: 8836 - DNA, 20 bp, Artificial Sequence
  Primer
tgtggccgaggactttgatt

SEQ ID NO: 8837 - DNA, 20 bp, Artificial Sequence
  Primer
tggcttttaggatggcaagg

SEQ ID NO: 8838 - DNA, 20 bp, Artificial Sequence
  Primer
gggggcttagtttgcttcct

SEQ ID NO: 8839 - DNA, 20 bp, Artificial Sequence
  Primer
aagtgcagcgttccttttgc

SEQ ID NO: 8840 - DNA, 20 bp, Artificial Sequence
  Primer
agcgttccttttgcgagaga

SEQ ID NO: 8841 - DNA, 20 bp, Artificial Sequence
  Primer
cgggctgttttccaaacatt

SEQ ID NO: 8842 - DNA, 20 bp, Artificial Sequence
  Primer
gaagggacacgcaggtggta

SEQ ID NO: 8843 - DNA, 20 bp, Artificial Sequence
  Primer
taccacctgcgtgtcccttc

SEQ ID NO: 8844 - DNA, 21 bp, Artificial Sequence
  Primer
gaggcacttgttctgctgctg

SEQ ID NO: 8845 - DNA, 1940 bp, Homo sapiens
acccagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgacagccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacgagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggcc

SEQ ID NO: 8846 - DNA, 594 bp, Homo sapiens; identical to SEQ ID NO: 8502
  misc_feature (1)..(594): n =A, C, T or G

SEQ ID NO: 8847 - DNA, 1223 bp, Homo sapiens
agctcggtcctgctggaggccacgggtgccacacactcggtcccgacatgatggcgagcatgcgagtggtgaaggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaactcatgttctgaccctctgtgcactggatcctcggcatagcggacggacacacctcatggactgaggccagagccccctgtggcccattccccattcatttttcccttcttaggttgttagtcattagtttgtgtgtgtgtgtggtggagggaagggagctatgagtgtgtgtgttgtgtatggactcactcccaggttcacctggccacaggtgcacccttcccacaccctttacattccccagagccaagggagtttaagtttgcagttacaggccagttctccagctctccatcttagagagacaggtcaccttgcaggcctgcttgcaggaaatgaatccagcagccaactcgaatccccctagggctcaggcactgagggcctggggacagtggagcatatgggtgggagacagatggagggtaccctatttacaactgagtcagccaagccactgatgggaatatacagatttaggtgctaaaccgtttattttccacggatgagtcacaatctgaagaatcaaacttccatcctgaaaatctatatgtttcaaaaccacttgccatcctgttagattgccagttcctgggaccaggcctcagactgtgaagtatatatcctccagcattcagtccagggggagccacggaaaccatgttcttgcttaagccattaaagtcagagatgaaaaaaaaaaaaaaaaaaaa

SEQ ID NO: 8848 - DNA, 2282 bp, C. elegans
gactccggggcgaccgccgcgagtccgcagtagttcgggccatggaggcggagccgccgctctacccgatggcgggggctgcggggccgcagggcgacgaggacctgctcggggtcccggacgggcccgaggccccgctggacgagctggtgggcgcgtaccccaactacaacgaggaggaggaggagcgccgctactaccgccgcaagcgcctgggcgtgctcaagaacgtgctggctgccagcgccgggggcatgctcacctacggcgtctacctgggcctcctgcagatgcagctgatcctgcactacgacgagacctaccgcgaggtgaagtatggcaacatggggctgcccgacatcgacagcaaaatgctgatgggcatcaacgtgactcccatcgccgccctgctctacacacctgtgctcatcaggttttttggaacgaagtggatgatgttcctcgctgtgggcatctacgccctctttgtctccaccaactactgggagcgctactacacgcttgtgccctcggctgtggccctgggcatggccatcgtgcctctttgggcttccatgggcaactacatcaccaggatggcgcagaagtaccatgagtactcccactacaaggagcaggatgggcaggggatgaagcagcggcctccgcggggctcccacgcgccctatctcctggtcttccaagccatcttctacagcttcttccatctgagcttcgcctgcgcccagctgcccatgatttatttcctgaaccactacctgtatgacctgaaccacacgctgtacaatgtgcagagctgcggcaccaacagccacgggatcctcagcggcttcaacaagacggttctgcggacgctcccgcggagcggaaacctcattgtggtggagagcgtgctcatggcagtggccttcctggccatgctgctggtgctgggtttgtgcggagccgcttaccggcccacggaggagatcgatctgcgcagcgtgggctggggcaacatcttccagctgcccttcaagcacgtgcgtgactaccgcctgcgccacctcgtgcctttctttatctacagcggcttcgaggtgctctttgcctgcactggtatcgccttgggctatggcgtgtgctcggtggggctggagcggctggcttacctcctcgtggcttacagcctgggcgcctcagccgcctcactcctgggcctgctgggcctgtggctgccacgcccggtgcccctggtggccggagcaggggtgcacctgctgctcaccttcatcctctttttctgggcccctgtgcctcgggtcctgcaacacagctggatcctctatgtggcagctgccctttggggtgtgggcagtgccctgaacaagactggactcagcacactcctgggaatcttgtacgaagacaaggagagacaggacttcatcttcaccatctaccactggtggcaggctgtggccatcttcaccgtgtacctgggctcgagcctgcacatgaaggctaagctggcggtgctgctggtgacgctggtggcggccgcggtctcctacctgcggattgagcagaagctgcggcggggcgtggccccgcgccagccccgcatcccgcggccccagcacaaggtgcgcggttaccgctacttggaggaggacaactcggacgagagcgacgcggagggcgagcatggggacggcgcggaggaggaggcgccgcccgcagggcccaggcctggccccgagcccgctggactcggccgccggccctgcccgtacgaacaggcgcaggggggagacgggccggaggagcagtgaggggccgcctggtccccggactcagcctccctcctcgccggcctcagtttaccacgtctgaggtcggggggaccccctccgagtcccgcgctgtcttcaaaggcccctgtctcccctccccgacgttggggacgcccctcccagagcccaggtcacctccgggcttccgcagccccctccaaggcggagtggagccttgggaacccctcggccaagcacaggggttcgaaaatacagctgaaaccccgcgggcccttagcacgcgccccagcgccggagcacggtcagggtcttcttgcgacccggcccgctccagatccccacagctttcggccgcggacccgggccgcgtgtgagcgcactttgcacctcctatccccagggtccgccgagagccacgattttttacagaaaatgagcaataaagagattttgtactgtcaaaaa

SEQ ID NO: 8849 - DNA, 2148 bp, Homo sapiens
gtaaaaatgacttggattgaaaatatgtggtagcctttttatttctacattaagttctacctaggatatttccaaggactgccacaaaacccatatgtgcagtactttactactttgggaaagctgcatctttctaccacattttaacatctaatatatttaatttctttgaagagggttctgtgtacgttattgtagttcccagtttaatatagttctttgtatctcttaacaggttgaagttattgcaaaacactctggaaagtaataattacatcataatcatttattttttaaacttaaaagcctagaaatttcctagaaagaaaataggagacatctcagagcaatttggttttggtgtatatgttctcaacagaaaaccagtgttaatgaatatcatgcctcagcactgtcacttttaaaacctgtcaggatcccaccgtaaaattggaaatgggcagttctgaattttcacgtttgaaatgtaaaatataaacttcagtcaatatccaggtttattgtgtcctactatttaataatgagagaagtaatggcaaggcctttactttcaggaaaggatagaagtatagattaatgactggaaagttttaatatatttagcccaaaggttactttgaattgaagtctttgcattgactgtttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacaatctacctggtcattattttatttctatccagttctaagaactgcctccactgtttatatattcataattaaacacattgagaatgcaacactataaaagctggtcaaatttttgcagagcccttattctgtgtgttttttgtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataattaatctgtaaattgtaataaatatatttgcaattattaaatgttaagtgat

SEQ ID NO: 8850 - DNA, 3022 bp, Homo sapiens
cggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccccaccccccccacccctgccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaacatt

SEQ ID NO: 8851 - DNA, 2750 bp, Homo sapiens
aatttagggttggggtacaatttgtttctattaagcaagtaccagtttaccaatacatgagtaactgaagtgtaactgttaaatgcttgtatactagtttttctttctgattgtcagtgatttataagctataaatgaccaaggtcctcagactgcttttagcatctgcaacttaaaaaaatgggagttagaaaaagaacaaatgctaaatagagtaacagttaaatgtatgtgtacactcttcccaaatgccaagagtgcagcggtggggtgagattcagatattcatttatttctaagtctgtagttaacatttatgttccctactccctacgtaagccagactttggcaacagtgatagttgattccaggcttatttgacttaaagtcactgaagtggaaactaagaagtggcagttagtgttttacccagcatttctgccttctctcttttcttcatgtgtttttgtctctagcctatgtgtatttgtgtagaataatgtgggatacctgaataatagatttaaaaggaccaagtggtaaaattgggcccaagctgaagtacaggcaaacttgatgtttgaaagataagttttgagaaatgtcattgtattttggagtaaaagaggctatcttagtaataaggaataaacttccataacactaggttagaccacccaataaatctagaaatcagcttttaaaaatattgtctgaagtctaacaaaagttttcacctctaatgtgttctttaagaaatttaaggaacttagccttggattcctgaatagaaaggtaagaattctatcattctggagttgatgaaaacataaattttcaggatgtgaaatgaacagtgatttataaaatggaaatcaaattgtacattagcagagttcttaagctttttgaattgaaggagacctaataattgtgtctttttggttatttagtgacaaacgtggctttcaaactatgcttaaaaagttccggctggacacggtggctcacacctataatcctagcacttggggaggctgaggcagatggattacctgaggtcaggagttcgagaccaacctggccgacatggtgaaacgctgtctctactaaaaatataaaaaattagccgggtgcagtggcgtgcacctgtaatcccagctactctggaggctgaggcaggagaatcacctgaacctgggaggtggaggtttcagtgagctgagatcctgccactgcactccagcctgggcgcaagaccaagacttaaacgcaaaaaaaaaaaaaaaaaaaaaaaaaaaagtttcataatacagcatggtctggtagtttgcaaaatggtgtgcttttggggagatacactagcaatttttttaaaaaatggaacagtgtgataggaagcctgctggatgatttcttaaatattctaaaatgtaagtcaaatatgttttaataacaaagacttaaatggcttttctccctagagactgaaactagtattcattgtgttcagaacttaattgggcttgaactgagatttaaatctaataaacaagttaataaatgtgtatgttttgttgtgggtttggtagtgatctgtggttctatagggtttaataggaattgcttttgatttgtttctggctttagaatgtgaggcaaattttacattcttggttctattaagattttcttaggcatgctaacatgccaacaaaaagccatgtaagtattgtataaaaagattcacattgttaatttagccattttgaaattcagatgagtgagcaagttgataatggcctcatctctgacctgagaaaaaacaactttgacccttgttcttaaaatgctttaaccttgaagttgcttgagacttaagaggtcatgttgctttaggtttaataaatagccttaactatttggaggggaaaagatgggtcaactttttttttttttttggcgtttgcatgtacaactttctatttttagcctatatttggaaagaaagcacttaacattttaggaattctttttaaagctgcttgcaaagtgttggtgattttactgaaaacttttgagatcttcattttacaggcagacctgtctaactacaagccagacttgggttttctcctgtagtttgaagacacactgactcctgacaaaatgcagcctgcaacttcctggagaacaactcagtgtcacattaaagtttattatgtatttaatgatacactgtttaattgacagttttgcatagtttgtctaactttagagaattaagagcctctcaactgagcagtaaaggtaaggagagctcaatctgcacagagccagtttttagtgtttgatggaaataagatcatcatgcccacttgagacttcagattattctttagcttagtggttgtatgagttacatcttattaaagtcgaaattaatgtagttttctgccttgataacatttcatatgtggtattagttttaaagggtcattaggaaaatgcacatattccatgaattttaagacccatagaaaagttgaagaatgcttaattttcttatccagtaatgtaaacacagagacagaacattgagatgtgcctagttccgtatttacagtttggtctggctgtttgagttctagcgcatttaatgttaataaataaaatactgaattttaaagctgttaagaaattgtccagaacgagaatattgaaataaaaacttcaaggttataatcgc

SEQ ID NO: 8852 - DNA, 1697 bp, Homo sapiens
ggaggagactcggatataccttctcagaagctgcacaggaggaaagcagtgacaaagaaagaagttgtcattctttgcacgaaactggatggcttctacagggagccaggcctctgatatagacgagatttttggattcttcaacgatggcgaacctcccaccaaaaagcccaggaagctgcttccaagcttaaaaactaagaagcctcgagaacttgtgctagtgattggaacaggcattagtgctgcagttgcgccccaagttccagccctcaaatcctggaaggggttaattcaggccttactggatgctgccattgattttgatcttttagaagatgaggagagcaaaaagtttcagaaatgtctccatgaagacaagaacctggtccatgttgcccatgaccttatccagaaactctctcctcgtaccagtaatgttcgatccacatttttcaaggactgtttatatgaagtatttgatgacttggagtcaaagatggaagattctggaaaacagctacttcagtcagttctccacctgatggaaaatggagccctcgtattaactacaaattttgataatctcttggaactgtatgcagcagatcaggggaaacagcttgaatcccttgaccttactgatgagaaaaaggtcctcgagtgggctcaggagaagcgtaagctgagcgtgttgcatattcacggagtctacaccaaccctagtggcattgtccttcatccggctggatatcagaacgtgctcaggaacactgaagtcatgagagaaattcagaaactctacgaaaacaagtcatttcttttcctgggctgtggctggactgtggatgacaccactttccaggcccttttcttggaggctgtcaagcataaatctgacctagaacatttcatgctggttcggagaggagacgtagatgagttcaaaaagcttcgagaaaacatgctggacaaggggattaaagtcatctcctatggagatgactatgccgatcttccagaatatttcaagcgactgacatgtgagatctccacaaggggtacatcagcagggatggtgagagaaggtcagctaaatggctcatctgcagcacacagtgaaataagaggctgtagtacatgagcgagctagagaaatcaccaccgtttagaccaagctgtaaggccctactacagacagtgtttaacaagtaaacttacaagaacccaacacaattcccagaaagtaacaatagccagaggttgaagggcggggtagaagaggggggaatgttgcagcgtaatccttcataccacctggttcttgatattctgccgcctgttcaagttcaagaataaaagcgacagcaggacccaaatgcagctcccaacccactccccaggctagacatgcttgtgtccacacagcacaccaatgtgatacttccactgaccggctgcagctctgcatgaaggactcggggtctggatgccatggaatcactgtggctcttgttgcagttttgtactctatacttggtttttcaattaagcttaatggcttttttaaaacatgacttgaagctctagttttctagatcttttacagtgtacagtattttacataactaagctgtattaaaagcttgttcatttaaaaaaaaaaaaaaaaaaaaaaaaaaaaaaaaaaaaaaaaa

SEQ ID NO: 8853 - DNA, 2530 bp, Homo sapiens
ctaaagtggagcccagcggcgggtgtgagagtccgtaaggagcagcttccaggatcctgagatccggagcagccggggtcggagcggctcctcaagagttactgatctatgaaatggcagagaatggaaaaaattgtgaccagagacgtgtagcaatgaacaaggaacatcataatggaaatttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcaaagcattgtggtgtcttttttactgctgcttgctgtgcttatagctacgtattatgttgaaggagtgcatcaacagtatgtgcaacgtatagagaaacagtttcttttgtatgcctactggataggcttaggaattttgtcttctgttgggcttggaacagggctgcacacctttctgctttatctgggtccacatatagcctcagttacattagctgcttatgaatgcaattcagttaattttcccgaaccaccctatcctgatcagattatttgtccagatgaagagggcactgaaggaaccatttctttgtggagtatcatctcaaaagttaggattgaagcctgcatgtggggtatcggtacagcaatcggagagctgcctccatatttcatggccagagcagctcgcctctcaggtgctgaaccagatgatgaagagtatcaggaatttgaagagatgctggaacatgcagagtctgcacaagactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaattgtgtccgttttcttgagcgttttgattttttacttttagcttataccagctgaatggcagccttgcctaatccacctacaacaagaatttcttaagctttcttttatttgcatgagagagccactaccaaggcatgttttgttatgctgaaactgggctgctgcatactgctaaatggcacctctgggattggcctacctggggatttcttggtttgtgaaaacaggagaggagaaatatctcatacaagtgaaaggatactggagagagaaattacccatttctaaaaaaaaaccacactctgtcgtatctgtgttaatgttttctagcatgtactctggtttcaacagacacaaatttatatgttaacccagttttcttgccgttctgtaagtgttttattcttagtgtgatttttttccattgggatgtttttgattgaacttgttcattttgttttgcttgggaggaaaataaacaattttacttttttccttaaaaaaaaaaaaaaa

SEQ ID NO: 8854 - DNA, 2939 bp, Homo sapiens
ggcgggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagagtccattccccttttccctcctgtgctctgtcccccaaggagtcatggaactcagggtactgggcctcaacgggaacctgagacagcttccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctaaaaaaaaaaaaaaaaaaa

SEQ ID NO: 8855 - DNA, 742 bp, Homo sapiens
catcgacctccaattgctcggaacccgcgccattgtgttggtacccggaaattcggccattatggccggggaaggatggcaatgccaggggaactacgctgcttgaggttctggactgcatcttaccaccaactggtccaactgacaggcccttgcgcctgcctttccaggatgtttacaaaatggggggaattggaactgttcctgttggccgagtggagactggggttttaaaacccggtatgggggtaacctttgttccagtcaacgttacaacggaggtaaaatctgtcgaaatgcaccatgaagctttgagtgaagcttttcctggggacaatggggccttaaatgtcaagaatgtgtttgtcaaggatgttcgtcgtggcaacgttgttgttgacagcaaaaatgacccaccaatggaagcagttggcttaactgttaaggggattatcctgaaccatccaggccaaataggcgccggttatgcccctgtatggaattgccacacggttaacatggcttgcaggtttgttgagctgaaggaaaggattgatcgccgttttgttagttgaaagatggccctaatattttgaagcctgttgaggttgccattgttgaaatggttcttgtcaggcccatgtgtgttgggggtttttaagattatcaaccttggggtcgttttgttgttcgcggattgagcacggaaggttccgctgggtgttatcggcatggtccaggt

SEQ ID NO: 8856 - DNA, 2422 bp, Homo sapiens
gtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggccgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttaaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctaaaaaaaaaaaaaaaaaaa

SEQ ID NO: 8857 - DNA, 1793 bp, Homo sapiens
cgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttccccctttttgtcccccaacttgagatgtatgaaggcttttggtctccctgggagtgggtggaggcagccagggcttacctgtacactgacttgagaccagttgaataaaagtgcacacctta

SEQ ID NO: 8858 - DNA, 914 bp, Homo sapiens
ggttctacttgtttgaacataaataaagagtatgcagcacgtttaataaaatcagaactcttaatggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgcttggcagtgtggcttttgcacacttgccctgtcttcctgagactacttcagtaagccatgcttccttcttccccacttttatttggtgtcatgaatagaaacttccaaatgtaaccatggaagctaagttggcctgcttgctttttagtctccacaccatgggcagaactgctgtctttactacttcatctcacccaagtcccgttcccaggcagccagggcctgggtttgaataattgcagggccagcctgcatgatctttctcacttactcctctcccattcagcaatcaaccagactaaggagtttgatccctagtgattacagcctgaagaaaattaaatctgaattaattttacatggcttccgtgatcttactgctgttcttactttttcgaatgtagttgggggtgggagggacaggtatggtattcaagagattaacttttgcctacgtgtttgtcaccagtagatctctggtaacagtgtctgtctcattcaatcttcatgtggaccagtcacagtgtccaggaatacttagtccttacggtgtaggactcataagtttcattctcacaaaggaaggtattacaaggattggggggcaaagaaagtacattgggtgaaaatttaaaaaggtatggagcattgaaaatgtaatt

SEQ ID NO: 8859 - DNA, 627 bp, Homo sapiens
ttggttgcttctgtgttactggatatgaaatatgatctgggaaatgagatgaaattggcttgaaacatgagagtgtcacaattcttacccataagttcagtcagccccggatgaaaggatggaaaaatatgacatagatctcttaaagggaatttattgcttgcatggagattttagatcgatgttactgaggaattaggtagctgggcggcttaccccaggcatctcttagtaggtaacaccttctttttcaggatgggattcacaagggcccttggtgtctggaagcaccaactgaacgcaggcctcggatgatcaagacggtccccaccacaatgcccacgaggcccacagacaaccccaaggcacagaccacagtctctgtgagctctgacataggtgctggaatctcaggctcccagtgtttcagaagaggctcatccaagccccagtgctccaccttgcagtcataaatctcatcagcaggaagggagaaaggtgaggtaactgatcttgaagaaggaatgatcactcttggagaagaagctggtctcagaaacaccttctgtgactgagtgcccattgctcagtcatgtgatgctgacccaaagaagtaagatgttgtcc

SEQ ID NO: 8860 - DNA, 2156 bp, Homo sapiens
ggcacgagcccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatgggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaaaaaaaaaaaaaaa

SEQ ID NO: 8861 - DNA, 2848 bp, Homo sapiens
ccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtgccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacgcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtggtttgtgatgaaaatggttccaagggctacggatttgtacactttgagacgcaggaagcagctgaaagagctattgaaaaaatgaatggaatgctcctaaatgatcgcaaagtatttgttggacgatttaagtctcgtaaagaacgagaagctgaacttggagctagggcaaaagaattcaccaatgtttacatcaagaattttggagaagacatggatgatgagcgccttaaggatctctttgggcctgccttaagtgtgaaagtaatgactgatgaaagtggaaaatccaaaggatttggatttgtaagctttgaaaggcatgaagatgcacagaaagctgtggatgagatgaacggaaaggagctcaatggaaaacaaatttatgttggtcgagctcagaaaaaggtggaacggcagacggaacttaagcgcaaatttgaacagatgaaacaagataggatcaccagataccagggtgttaatctttatgtgaaaaatcttgatgatggtattgatgatgaacgtctccggaaagagttttctccatttggtacaatcactagtgcaaaggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacagactcagaaccgtgctgcatactatcctcctagccaagttgctcaactaagaccaagtcctcgctggactgctcagggtgccagacctcatccattccaaaatatgcccggtgctatccgcccagctgctcctagaccaccatttagtactatgagaccagcttcttcacaggttccacgagtcatgtcaacacagcgtgttgctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacagcctgctgttcatgtacaaggtcaggaacctttgactgcttccatgttggcatctgcccctcctcaagagcaaaagcaaatgttgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtg

SEQ ID NO: 8862 - DNA, 1096 bp, Homo sapiens
atgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaatacatgcctggggtaagccacccggctacctaattcctcagtaacctccatctaaaatctccaaggaagcaataaattccttttatgag

SEQ ID NO: 8863 - DNA, 1512 bp, Homo sapiens
cggccgcgttctgtggttttccgctattcccccagacccgcaccttctcggcctctttgcggagaatcgtgaccaagatgtggaacagtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctaccg

SEQ ID NO: 8864 - DNA, 1619 bp, Homo sapiens
gtcatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataacgcccagcctgggtgcagcccacctggacagagtccgaatcctactccatccttcatggagacccctggtgctgggtccctgctgctttctctacctcaaggggcttggcaggggtccctgctgctgacctccccttgaggaccctcctcacccactccttccccaagttggaccttgatatttattctgagcctgagctcagataatatattatatatattatatatatatatatatttctatttaaagaggatcctgagtttgtgaatggacttttttagaggagttgttttggggggggggtcttcgacattgccgaggctggtcttgaactcctggacttagacgatcctcctgcctcagcctcccaagcaactgggattcatcctttctattaattcattgtacttatttgcctatttgtgtgtattgagcatctgtaatgtgccagcattgtgcccaggctagggggctatagaaacatctagaaatagactgaaagaaaatctgagttatggtaatacgtgaggaatttaaagactcatccccagcctccacctcctgtgtgatacttgggggctagcttttttctttctttcttttttttgagatggtcttgttctgtcaaccaggctagaatgcagcggtgcaatcatgagtcaatgcagcctccagcctcgacctcccgaggctcaggtgatcctcccatctcagcctctcgagtagctgggaccacagttgtgtgccaccacacttggctaactttttaatttttttgcggagacggtattgctatgttgccaaggttgtttacatgccagtacaatttataataaacactcatttttcc

SEQ ID NO: 8865 - DNA, 2431 bp, Homo sapiens
gttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaacggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaagagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgcaggatgaagaggtcttcaggaagccaacagtgccatcatgtatctaagaccctggagaggcagatgcagcctcaggaccagctgaaatgtgagttcctcctcttgaaggcctactgtcatccacaaagctccttttttacgggcatcccatttaatattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatcta

SEQ ID NO: 8866 - DNA, 8187 bp, Homo sapiens
cccgagaagcggcggggcggcgggccggcgggcggggcgcagagccaggcagcgcaggtatagccaggctggagaaaagaagctgccaccatggttgcactttcactgaagatcagcattgggaatgtggtgaagacgatgcagtttgagccgtctaccatggtgtacgacgcctgccgcatcattcgtgagcggatcccagaggccccagctggtcctcccagcgactttgggctctttctgtcagatgatgaccccaaaaagggtatatggctggaggctgggaaagctttggactactacatgctccgaaatggggacactatggagtacaggaagaaacagagacccctgaagatccgtatgctggatggaactgtgaagacgatcatggtggatgactctaagactgtcactgacatgctcatgaccatctgtgcccgcattggcatcaccaatcatgatgaatattcattggttcgagagctgatggaagagaaaaaggaggaaataacagggaccttaagaaaggacaagacattgctgcgagatgaaaagaagatggagaaactaaagcagaaattgcacacagatgatgagttgaactggctggaccatggtcggacactgagggagcagggtgtagaggagcacgagacgctgctgctgcggaggaagttcttttactcagaccagaatgtggattcccgggaccctgtacagctgaacctcctgtatgtgcaggcacgagatgacatcctgaatggctcccaccctgtctcctttgacaaggcctgtgagtttgctggcttccaatgccagatccagtttgggccccacaatgagcagaagcacaaggctggcttccttgacctgaaggacttcctgcccaaggagtatgtgaagcagaagggagagcgtaagatcttccaggcacacaagaattgtgggcagatgagtgagattgaggccaaggtccgctacgtgaagctagcccgttctctcaagacttacggtgtctccttcttcctggtgaaggaaaaaatgaaagggaagaacaagctagtgcccaggcttctgggcatcaccaaggagtgtgtgatgcgagtggatgagaagaccaaggaagtgatccaggagtggaacctcaccaacatcaaacgctgggctgcgtctcccaaaagcttcaccctggattttggagattaccaagatggctattactcagtacagacaactgaaggggagcagattgcacagctcattgccggctacatcgatatcatcctgaagaagaaaaaaagcaaggatcactttgggctggaaggagatgaggagtctactatgctggaggactcagtgtcccccaaaaagtcaacagtcctgcagcagcaatacaaccgggtggggaaagtggagcatggctctgtggccctgcctgccatcatgcgctctggagcctctggtcctgagaatttccaggtgggcagcatgccccctgcccagcagcagattaccagcggccagatgcaccgaggacacatgcctcctctgacttcagcccagcaggcactcactggaaccattaactccagcatgcaggccgtgcaggctgcccaggccaccctggatgactttgacactctgccgcctcttggccaggatgctgcctctaaggcctggcgtaaaaacaagatggatgaatcaaagcatgagatccactctcaggtagatgccatcacagctggtactgcgtctgtggtgaacctgacagcaggggaccctgctgagacagactataccgcagtgggctgtgcagtcaccacaatctcctccaacctgacggagatgtcccgtggggtgaagctgctggctgccttgctggaggacgaaggcggcagtggtcggcccctgttgcaggcagcaaagggccttgcgggagcagtgtcagaactgctgcgcagtgcccaaccagccagtgctgagccccgtcagaacctgctgcaagcagctgggaacgtgggccaggccagtggggagctgttgcaacaaattggggaaagtgatactgacccccacttccaggatgcgctaatgcagctcgccaaagctgtggcaagtgctgcagctgccctggtcctcaaggccaagagtgtggcccagcggacagaggactcgggacttcagacccaagttattgctgcagcaacacagtgtgccctatccacttcccaactagtggcctgtactaaggtggtggcacctacaatcagctcacctgtctgccaagagcaactggtggaggctggacgactggtagccaaagccgtggagggctgtgtgtctgcctcccaggcagctacagaggatgggcaactgttgcgaggggtaggagcagcagccacagctgtcacccaggccctaaatgagctgctgcagcatgtgaaagcccatgccacaggggctgggcctgctggccgttatgaccaggctactgacaccatcctaaccgtcactgagaacatctttagctccatgggtgatgctggggagatggtgggacaggcccgcatcctggcccaagccacatctgacctggtcaatgccatcaaggctgatgctgagggggaaagtgatctggagaactcccgcaagctcttaagtgctgccaagatcctagctgatgccacagccaagatggtagaggctgccaagggagcagctgcccaccctgacagtgaggagcagcagcagcggctgcgggaggcagctgaggggctgcgcatggccaccaatgcagctgcgcagaatgccatcaagaaaaagctggtgcagcgcctggagcatgcagccaagcaggctgcagcctcagccacacagaccatcgctgcagctcagcacgcagcctctacccccaaagcctctgccggcccccagcccctgctggtgcagagctgcaaggcagtggcagagcagattccactgctggtgcagggcgtccgaggaagccaagcccagcctgacagccccagcgctcagcttgccctcattgctgccagccagagcttcctgcagccaggtgggaagatggtggcagctgcaaaggcctcagtgccaacgattcaggaccaggcttcagccatgcagctgagtcagtgtgccaagaacctgggcaccgcgctggctgaactccggacggctgcccagaaggctcaggaagcatgtggacctttggagatggattctgcactgagtgtggtacagaatctagagaaagatctacaggaagtgaaggcagcagctcgagatggcaagcttaaacccttacctggggagacaatggagaagtgtacccaggacctgggcaacagcaccaaagccgtgagctcagccatcgcccagctactgggagaggttgcccagggcaatgagaattatgcaggtattgcagctcgggatgtggcaggtgggctgcggtcactggcccaggccgctaggggagtcgctgcactgacgtcagatcctgcagtgcaggccattgtacttgatacggccagtgatgtgctggacaaggccagcagcctcattgaggaggcgaaaaaggcagctggccatccaggggaccctgagagccagcagcggcttgcccaggtggctaaagcagtgacccaggctctgaaccgctgtgtcagctgcctacctggccagcgcgatgtggataatgccctgagggcagttggagatgccagcaagcgactcctgagtgactcgcttcctcctagcactgggacatttcaagaagctcagagccggttgaatgaagctgctgctgggctgaatcaggcagccacagaactggtgcaggcctctcggggaacccctcaggacctggctcgagcctcaggccgatttggacaggacttcagcaccttcctggaagctggtgtggagatggcaggccaggctccgagccaggaggaccgagcccaagttgtgtccaacttgaagggcatctccatgtcttcaagcaaacttcttctggctgccaaggccctgtccacggaccctgctgcccctaacctcaagagtcagctggctgcagctgccagggcagtaactgacagcatcaatcagctcatcactatgtgcacccagcaggcacccggccagaaggagtgtgataacgccctgcgggaattggagacggtccgggaactcctggagaacccagtccagcccatcaatgacatgtcctactttggttgcctggacagtgtaatggagaactcaaaggtgctgggcgaggccatgactggcatctcccaaaatgccaagaacggaaacctgccagagtttggagatgccatttccacagcctcaaaggcactttgtggcttcaccgaggcagctgcacaggctgcatatctggttggtgtctctgaccccaatagccaagctggacagcaagggctagtggagcccacacagtttgcccgtgcaaaccaggcaattcagatggcctgccagagtttgggagagcctggctgtacccaggcccaggtgctctctgcagccaccattgtggctaaacacacctctgcactgtgtaacagctgtcgcctggcttctgcccgtaccaccaatcctactgccaagcgccagtttgtacagtcagccaaggaggtggccaacagcacagctaatcttgtcaagaccatcaaggcgctagatggggccttcacagaggagaaccgtgcccagtgccgagcagcaacagcccctctgctggaggctgtggacaatctgagtgcctttgcgtccaaccctgagttctccagcattcctgcccagatcagccctgagggtcgggctgccatggagcccattgtgatctctgccaagacaatgttagagagtgccgggggactcatccagacagcccgggccctcgcagtcaatccccgggaccccccgagctggtcggtgctggccggccactcccgtactgtctcagactccatcaagaagctaattacaagcatgagggacaaggctccagggcagctggagtgtgaaacggccattgcagctctgaacagttgtctacgggacctagaccaggcttccctcgctgcagtcagccagcagcttgctccccgtgagggaatctctcaagaggccttgcacactcagatgctcactgcagtccaagagatctcccatctcattgagccgctggccaatgctgcccgggctgaagcctcccagctgggacacaaggtgtcccagatggcgcagtactttgagccgctcaccctggctgcagtgggtgctgcctccaagaccctgagccacccgcagcagatggcactcctggaccagactaaaacattggcagagtctgccctgcagttgctatacactgccaaggaggctggtggtaacccaaagcaagcagctcacacccaggaagccctggaggaggctgtgcagatgatgaccgaggccgtagaggacctgacaacaaccctcaacgaggcagccagtgctgctggggtcgtgggtggcatggtggactccatcacccaggccatcaaccagctagatgaaggaccaatgggtgaaccagaaggttccttcgtggattaccaaacaactatggtgcggacagccaaggccattgcagtgaccgttcaggagatggttaccaagtcaaacaccagcccagaggagctgggccctcttgctaaccagctgaccagtgactatggccgtctggcctcggaggccaagcctgcagcggtggctgctgaaaatgaagagataggttcccatatcaaacaccgggtacaggagctgggccatggctgtgccgctctggtcaccaaggcaggcgccctgcagtgcagccccagtgatgcctacaccaagaaggagctcatagagtgtgcccggagagtctctgagaaggtctcccacgtcctggctgcgctccaggctgggaatcgtggcacccaggcctgcatcacagcagccagcgctgtgtctggtatcattgctgacctcgacaccaccatcatgttcgccactgctggcacgctcaatcgtgagggtactgaaactttcgctgaccaccgggagggcatcctgaagactgcgaaggtgctggtggaggacaccaaggtcctggtgcaaaacgcagctgggagccaggagaagttggcgcaggctgcccagtcctccgtggcgaccatcacccgcctcgctgatgtggtcaagctgggtgcagccagcctgggagctgaggaccctgagacccaggtggtactaatcaacgcagtgaaagatgtagccaaagccctgggagacctcatcagtgcaacgaaggctgcagctggcaaagttggagatgaccctgctgtgtggcagctaaagaactctgccaaggtgatggtgaccaatgtgacatcattgcttaagacagtaaaagccgtggaagatgaggccaccaaaggcactcgggccctggaggcaaccacagaacacatacggcaggagctggcggttttctgttccccagagccacctgccaagacctctaccccagaagacttcatccgaatgaccaagggtatcaccatggcaaccgccaaggccgttgctgctggcaattcctgtcgccaggaagatgtcattgccacagccaatctgagccgccgtgctattgcagatatgcttcgggcttgcaaggaagcagcttaccacccagaagtggcccctgatgtgcggcttcgagccctgcactatggccgggagtgtgccaatggctacctggaactgctggaccatgtactgctgaccctgcagaagccaagcccagaactgaagcagcagttgacaggacattcaaagcgtgtggctggttccgtcactgagctcatccaggctgctgaagccatgaagggaacagaatgggtagacccagaggaccccacagtcattgctgagaatgagctcctgggagctgcagccgccattgaggctgcagccaaaaagctagagcagctgaagccccgggccaaacccaaggaggcagatgagtccttgaactttgaggagcagatactagaagctgccaagtccattgcagcagccaccagtgcactggtaaaggctgcgtcggctgcccagagagaactagtggcccaagggaaggtgggtgccattccagccaatgcactggacgatgggcagtggtcccagggcctcatttctgctgcccggatggtggctgcggccaccaacaatctgtgtgaggcagccaatgcagctgtacaaggccatgccagccaggagaagctcatctcatcagccaagcaggtagctgcctccacagcccagctccttgtggcctgcaaggtcaaggctgaccaggactcggaggcaatgaaacgacttcaggctgctggcaacgcagtgaagcgagcctcagataatctggtgaaagcagcacagaaggctgcagcctttgaagagcaggagaatgagacagtggtggtgaaagagaagatggttggcggcattgcccagatcatcgcagcacaggaagaaatgcttcggaaggaacgagagctggaagaggcgcggaagaaactggcccagatccggcagcagcagtacaagtttctgccttcagagcttcgagatgagcactaaagaagcctcttctatttaatgcagacccggcccagagactgtgcgtgccactaccaaagccttctgggctgtcggggcccaacctgcccaaccccagcactccccaaagtgcctgccaaaccccagggcctggccccgcccagtcccgcagtacatcccctgtcccctccccaaccccaagtgccttcatgccctagggccccccaagtgcctgcccctccccagagtattaacgctccaagagtattattaacgctgctgtacctcgatctgaatctgccggggccccagcccactccaccctgccagcagcttccagccagtccccacagcctcatcagctctcttcaccgttttttgatactatcttcccccacccccagctacccataggggctgcagagttataagccccaaacaggtcatgctccaataaaaatgattctacctacaaaaaaaaaaaaaaaaaaa

SEQ ID NO: 8867 - DNA, 1079 bp, Homo sapiens
ctgacgacttgaagccagaggcaccgccagttggccccagcccgcagcatggcagccgccgcctatgtggaccacttcgccgccgagtgcctcgtgtccatgtcgagccgcgcggtcgtgcacgggccgcgggaggggccggagtcccggcccgagggcgcgtccgtggccgccacccccacgctgccccgcgtcgaggagcgccgcgacggtaaggacagcgcctcgctcttcgtggtagcgcggatcctagcggacctcaaccagcaagcgccggcgcccgccccggcggagcgcagggagggcgccgcggcccggaaggcgaggaccccctgccgcctgccgccgcccgcccccatgagcccacctcccccggcgctgaaggcgcggcgagccgcgccccccagcccggcgtggagcgagccggagcccgaggcggggctggagcccgagcgggagccggggcccgcggggagcggcgagcccggcctcagacaaagggtccggcggggccgaagtcgcgccgacctcgagtccccgcagaggaagcacaagtgccactacgcgggctgcgagaaagtttacgggaaatcttcgcacctcaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgcacagccatgagcagccgctcccaccccctcgtgagtccctggcctttccttttgttataagaaagaagagagagaacttgatgccaagtccacgaaaaaacaatttttttcacctcaggtgtcaaagtaaatttgttaaaaaaaaaaaaaaaaaa

SEQ ID NO: 8868 - DNA, 1242 bp, Homo sapiens
atttcatgttatacttaataaaacaaaacatacctgtatacacacacattcactcacattgaagatgcaagatgaagaaagatacatgacattgaatgtacagtcaaagaaaaggagttctgcccaaacatctcaacttacatttaaagattattcagtgacgttgcactggtataaaatcttactgggaatatctggaaccgtgaatggtattctcactttgactttgatctccttgatcctgttggtttctcagggagtattgctaaaatgccaaaaaggaagttgttcaaatgccactcagtatgaggacactggagatctaaaagtgaataatggcacaagaagaaatataagtaataaggacctttgtgcttcgagatctgcagaccagacagtactatgccaatcagaatggctcaaataccaagggaagtgttattggttctctaatgagatgaaaagctggagtgacagttatgtgtattgtttggaaagaaaatctcatctactaatcatacatgaccaacttgaaatggcttttatacagaaaaacctaagacaattaaactacgtatggattgggcttaactttacctccttgaaaatgacatggacttgggtggatggttctccaatagattcaaagatattcttcataaagggaccagctaaagaaaacagctgtgctgccattaaggaaagcaaaattttctctgaaacctgcagcagtgttttcaaatggatttgtcagtattagagtttgacaaaattcacagtgaaataatcaatgatcactatttttggcctattagtttctaatattaatctccaggtgtaagattttaaagtgcaattaaatgccaaaatctcttctcccttctccctccatcatcgacactggtctagcctcagagtaacccctgttaacaaactaaaatgtacacttcaaaatttttacgtgatagtataaaccaatgtgacttcatgtgatcatatccaggatttttattcgtcgcttattttatgccaaatgtgatcaaattatgcctgtttttctgtatcttgcgttttaaattcttaataaggtcctaaacaaaatttcttatatttctaatggttgaattataatgtgggtttatacattttttacccttttgtcaaagagaattaactttgtttccaggcttttgctactcttcactcagctacaataaacatcctgaatgttttcttaaaaaa

SEQ ID NO: 8869 - DNA, 290 bp, Homo sapiens
  misc_feature (1)..(290): n =A, C, T or G
acatggctgggggagggactgctgacccaccaaggtctcacactcctcctgccagctctgtcaccctggccaccacccaacctgtccttactcagagctgcgggctgagggcatctctgagtgtctctgcctgggagcaggggtggtttctacggtgacagtgacgtgactcagagcttttcgaactgtgctcccacggggaccactgggcccttcaggggaagctgctaggggaaggactggcctggctccagaatgttgttgcctttttaagttttgtttnttcacat

SEQ ID NO: 8870 - DNA, 418 bp, Homo sapiens
gggatccagtgtccacacttaaaagttgtatgtgtttaaaaaacaacaacagtaatgtgcaaggtgaaatgcttttgggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtg

SEQ ID NO: 8871 - DNA, 2745 bp, Homo sapiens
acctccctccgcggagcagccagacagcgagggccccggccgggggcaggggggacgccccgtccggggcaccccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggagcctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgccgctgctgctaccgctgctgtggctactggtgctgacgcctggcccgccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacaccgtgccccaagcccacctggggccccattaaagatggagagaggactgcggatctctgtgtcattgggcgcctgcctggggtctccatccctgacgttcccccactcccactccctctctctccctctctgcctcctcctgcctgtctgcactattcctttgcccggcatcaaggcacaggggaccagtggggaacactactgtagttagatctatttattgagcaccttgggcactgttgaagtgccttacattaatgaactcattcagtcaccatagcaacactctgagatggcagggactctgataacacccattttaaaggttgaggaaacaagcccagagaggttaagggaggagttcctgcccaccaggaacctgctttagtgggggatagtgaagaagacaataaaagatagtagttcaggccaggcggggtgctcacgcctgtaatcctagcacttttgggaggcagagatgggaggatacttgaatccaggcatttgagaccagcctgggtaacatagtgagaccctatctctacaaaacacttttaaaaaatgtacacctgtggtcccagctactctggaggctaaggtgggaggatcacttgatcctgggaggtcaaggctgcag

SEQ ID NO: 8872 - DNA, 1797 bp, Homo sapiens
ccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcagggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggcccccctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaa

SEQ ID NO: 8873 - DNA, 1314 bp, Homo sapiens
atggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcaatttgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 8874 - DNA, 1326 bp, Homo sapiens
atggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggttgggtgtacgatgtgtcagcagagcatgcagaagtcctcgctggagtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcggagtgaacaggcccagctcgggaaaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggagaaatgccggtggttagcttcatcaaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtctcgccacagcaatcaggcaagagaaagaagtaaaaggcaccc

SEQ ID NO: 8875 - DNA, 2848 bp, Homo sapiens; identical to SEQ ID NO: 8861

SEQ ID NO: 8876 - DNA, 2415 bp, Homo sapiens
cggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtatctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacc

SEQ ID NO: 8877 - DNA, 325 bp, Homo sapiens
cagcctgtgctgactcaatcatcctctgcctctgcttccctgggatcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacattcgggtgttcggcggagggaccaagctga

SEQ ID NO: 8878 - DNA, 4204 bp, Homo sapiens
caggacagggaagagcgggcgctatggggagccggacgccagagtcccctctccacgccgtgcagctgcgctggggcccccggcgccgacccccgctcgtgccgctgctgttgctgctcgtgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggcccagcctccctgaagcctttgcattttggagagtttcctgaaacaactggaaagataactaggaaatccattcacagttctttgggccagacatgccacaaggacttcctgtccagctccaacctgcaaagatctgtcctcagccttgccagagatccaaaagaagcccccagtaagaacctggaacttggggagttaagacctggcagctctggacagccccaccctggtgggccaacaaagaacactaactatgcatggtgccccaggaccagctcaggacagatgccacaaggatagatgctggcccagggccagagcccagctccaaggggaatcagaactcaaatggggccagatccagcctggggtctggagttgatctggaacccagactcagacattggcaccaatccaggcagatccaggactatatttgggcctgctccagacctgatcctggaggcccagttcaccctgatttaggagaagccaggaatttcccaggacctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaa

SEQ ID NO: 8879 - DNA, 738 bp, Homo sapiens
aaagcagaattgagagtttgttcttacacacaagtttaatgccaccttcctctgtctgccatggaccaacaagcaatatatgctgagttaaacttacccacagactcaggcccagaaagttcttcaccttcatctcttcctcgggatgtctgtcagggttcaccttggcatcaatttgccctgaaacttagctgtgctgggattattctccttgtcttggttgttactgggttgagtgtttcagtgacatccttaatacagaaatcatcaatagaaaaatgcagtgtggacattcaacagagcaggaataaaacaacagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattgatacacacacagaacctgatacgtgacaaagcaattctgttttggattggattaaatttttcattatcagaaaagaactggaagtggataaacggctcttttttaaattctaatgacttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactcttga

SEQ ID NO: 8880 - DNA, 726 bp, Homo sapiens
gctgccccagaacaaccagctggatcagttctcacaggagccacagctcagagactgggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcaggtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtccttgtgaaccctgcaataaactgctttgcaaattcatc

SEQ ID NO: 8881 - DNA, 2513 bp, Homo sapiens
gtcactcagcctatggagatgaagaaactgaggttcagagaggttaagagactccactgaggtcacacagccgatgacagacaaccttctgtgccttcatcaagctggttgtgtacccaccatgtccctggcgacaggattgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttattttctttggatgtgaaaggaaatcactggttaaagcttgatcgagagacattatcagctctttaaggattgcaggagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgactgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgctgtggtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttgacagcatctactcagcaaggtcactaagctctgccagcgtggcagagcatgtcttggaacctgtcttgagtgggacaacgtccccccactgctgccctagagctggggagacgctcagggaaaggttcaacctccacacactaaaatcatttgctcctgggcaagcttgggaatgaatgtggaagatcctatattctgagagacaggacagtttcccaggaagatgggcagagacttgagtggcgattacctccagcacagagacgtgccaggcggtgttggcgctcggggcgagatgctgcccttcttttgcacgaagcctggcctcttgcttggcgtgataaccctgtcatcttcccaaagctcatttatgagccaccagaggctcctaccccaaagatttcacagaaacttgaggccaggtgccgtggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggaacaag

SEQ ID NO: 8882 - DNA, 506 bp, Homo sapiens
  misc_feature (1)..(506): n =A, C, T or G
ctgtacatctatcgacatggtgaggtagagcatgtttgggaggaaagacgttgaatcccatttggtgacagtgagcttgaggtgctgccagaacactgcactgaagataggaggagactgtaggaaatacaagataggaaaggtctccactgaaatgttaactctttctctctaaacggccatccaggcctcaatgtctgcagtttctgatctgtgattatgacttatccaaatcttacatttcttaaaaatagtcatagatgaagggaatcacagttgatagttatatggtgacattagtggcttaaattctaaataactagaaactgtataataggcaaaactgtgaggcaaataaaatgcttctcaaactgtgtggctcttatggggttaatttgatttggacctgtattaattcttatggctgctatactaacaaattccacaacttggtggtttaancacacacatttatctcttctgtctggagncagaagntaaaatga

SEQ ID NO: 8883 - DNA, 493 bp, Homo sapiens
gacatagatctcttaaagggaatttattgcttccatgggagatttagatagatgttactgagggattaagtagctgggcggcttaacccaggcatcctcttaatagggaaaaacctccttttcaggaagggaatcacaaggggccttggtgtctggaagccacaactggaagcaggcctcggatgagtaagaaggttcccaccaaaatggccaagagggccacagaaaaccccagggggcaggacacagtttttgtgaggtctggaataagtgttggaatcttagggtcccagtgttttagaagaaggtcatacaaggcccagtggtccaccttggagttcttaatttcatctatcgaaaggaggaaggtgaggtgactggtctttaagaaggaatgattaatcctggagaggaagctgggttcagaaacaccctctgtgactgagtggccattgtctcgccaggtgatgttggacccaagagagaagaagtt

SEQ ID NO: 8884 - DNA, 543 bp, Homo sapiens
tttttttttttttttttttttttttttttttttttttttttcccaggtcaagtttaatacaaaccacaaaagattaagggggggccctactaatacatcatacaaaccaggggccggcccccaaccccaactcaggccattcctaccaaaggaaaaaagggtggtctctcccccccctgtgggaaaggccggccttgtgaaacaccacaattcggctgaatctgaagtcttgggttttactaagggaaaaaaaaaatccaaaaaagggtttgttctcatgggtgccccccgcagcctggccctaaaacagcccagcgctcacttttgctgggaaaaatattctttgctctttgggacatcaggcttgaggggatcactgccaggtttccagccagctgggcccacttccccatgtttgtcagggaactggaaggcctgaactagtctcaaagtctcatccacagagcggccaacagggaggtcatttcagggatctgccgaagaaccccttatcatcaatgataagagggccccgtgacgaga

SEQ ID NO: 8885 - DNA, 524 bp, Homo sapiens
  misc_feature (1)..(524): n =A, C, T or G
tcttcttggcattggsgtgctccttctcgccatcaattcctgcctgcgggggggggggggttaataagccaaaccccaggggtgccggcatcttcctggctgcttcctcccatggggtcttgccctactgcagccccaaatctttcctctctcttcagacatcttggcttccctgacctagacagtcctgactgatggtccagcctcaatcccacttatttttggctaggccttcctgggagtcataaaagagntgnatccattctagaggtgcacagcctgtctcttccctcacaaatgtcagtccccaagtcattctgatccaccttcctaatatttttgccacctccaacttctttcaagatgaaaaggaaatgtagagaagcaaggwcagggtagacacttaatcccactgactgtctwtaatccactcttctccctctcwacctggatgatctccacactcctatccatactcagatwcaggatatattgttcccctatttatgtgctaagcactttca

SEQ ID NO: 8886 - DNA, 385 bp, Homo sapiens
tcgatgtgaatcttgttgtccaacaaccgcgtcaggcctgcttgctcggccagggccatcaccgggaccaggcccgcgcaggacacgagattgtcctcgtcgaacacagcagagtcagggccgaacgtgtgggacacttgcactggaagtgcctttcttgaaccggtcagatcgttgcgtagagaacaccaatctttccagttcagagggcactttcatcattccgacacccggacaaccagcctgtttatcggtggatcaaggctaagcccagcggttcgcaagcaacttgaaactcggcatgtcctccagaaacaccagcgcctcatagatccgctgatacccgggggctggggatccgccaagcaccgtcctcatccttgcg

SEQ ID NO: 8887 - DNA, 2281 bp, Homo sapiens
agctgaggtgtgagcagctgccgaagtcagttccttgtggagccggagctgggcgcggattcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttaaaaaaaaaaaaaaaaaaaa

SEQ ID NO: 8888 - DNA, 417 bp, Homo sapiens
taatgtgctgggggtgctttctggaatggctggattcttggagattcgagcagcaaatggctcatacatatggtacagagatcggatcacacaagcccggagacagtgcagcttctccactgactctggtcgcagacgcaaaggcagggaagcatccagcgtgtagtgccttcggtacaacctggtccaaaaggcagcagtgcaagtgacagtccaggcattcttacaaatcagggaaaaattcacaatgtcctcaggacggatataggaggccagcaatagccaaatatccatgggatactcttctcctccagccccgtccagttcttctttgtgtctcttgcttttcttttttctggagacagttctctcatggatgttttcctcctgggcatcccatctcatcactgctgtcga

SEQ ID NO: 8889 - DNA, 6270 bp, Homo sapiens
gccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtcaggccggctccgcggtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgtgcctacaggggttgtggaaggagacgctgcccccggtctatgccctggaattgctgaccatcttcgcctgggagcagggctgtaagaaggatgctttcagcctaggcgaaggcctccgaactgtcctgggcctgatccaacagcatcagcacctgtgtgttttctggactgtcaactatggcttcgaggaccctgcagttgggcagttcttgcagcggcacgttaagagacccaggcctgtgatcctggacccagctgaccccacatgggacctggggaatggggcagcctggcactgggatttgcatgcccaggaggcagcatcctgctatgaccacccatgctttctgagggggatgggggacccagtgcagtcttggaaggggccgggccttccacgtgctggatgctcaggtttgggccaccccatccagctagaccctaaccagaagacccctgaaaacagcaagagcctcaatgctgtgtacccaagagcagggagcaaacctccctcatgcccagctcctggccccactgcggagccagcatcgtacccctctgtgccgggaatggccttggacctgtctcagatccccaccaaggagctggaccgcttcatccaggaccacctgaagccgagcccccagttccaggagcaggtgaaaaaggccatcgacatcatcttgcgctgcctccatgagaactgtgttcacaaggcctcaagagtcagtaaagggggctcatttggccggggcacagacctaagggatggctgtgatgttgaactcatcatcttcctcaactgcttcacggactacaaggaccaggggccccgccgcgcagagatccttgatgagatgcgagcgcacgtagaatcctggtggcaggaccaggtgcccagcctgagccttcagtttcctgagcagaatgtgcctgaggctctgcagttccagctggtgtccacagccctgaagagctggacggatgttagcctgctgcctgccttcgatgctgtggggcagctcagttctggcaccaaaccaaatccccaggtctactcgaggctcctcaccagtggctgccaggagggcgagcataaggcctgcttcgcagagctgcggaggaacttcatgaacattcgccctgtcaagctgaagaacctgattctgctggtgaagcactggtaccgccaggttgcggctcagaacaaaggaaaaggaccagcccctgcctctctgcccccagcctatgccctggagctcctcaccatctttgcctgggagcagggctgcaggcaggattgtttcaacatggcccaaggcttccggacggtgctggggctcgtgcaacagcatcagcagctctgtgtctactggacggtcaactatagcactgaggacccagccatgagaatgcaccttcttggccagcttcgaaaacccagacccctggtcctggaccccgctgatcccacctggaacgtgggccacggtagctgggagctgttggcccaggaagcagcagcgctggggatgcaggcctgctttctgagtagagacgggacatctgtgcagccctgggatgtgatgccagccctcctttaccaaaccccagctggggaccttgacaagttcatcagtgaatttctccagcccaaccgccagttcctggcccaggtgaacaaggccgttgataccatctgttcatttttgaaggaaaactgcttccggaattctcccatcaaagtgatcaaggtggtcaagggtggctcttcagccaaaggcacagctctgcgaggccgctcagatgccgacctcgtggtgttcctcagctgcttcagccagttcactgagcagggcaacaagcgggccgagatcatctccgagatccgagcccagctggaggcatgtcaacaggagcggcagttcgaggtcaagtttgaagtctccaaatgggagaatccccgcgtgctgagcttctcactgacatcccagacgatgctggaccagagtgtggactttgatgtgctgccagcctttgacgccctaggccagctggtctctggctccaggcccagctctcaagtctacgtcgacctcatccacagctacagcaatgcgggcgagtactccacctgcttcacagagctacaacgggacttcatcatctctcgccctaccaagctgaagagcctgatccggctggtgaagcactggtaccagcagtgtaccaagatctccaaggggagaggctccctacccccacagcacgggctggaactcctgactgtgtatgcctgggagcagggcgggaaggactcccagttcaacatggctgagggcttccgcacggtcctggagctggtcacccagtaccgccagctctgtatctactggaccatcaactacaacgccaaggacaagactgttggagacttcctgaaacagcagcttcagaagcccaggcctatcatcctggatccggctgacccgacaggcaacctgggccacaatgcccgctgggacctgctggccaaggaagctgcagcctgcacatctgccctgtgctgcatgggacggaatggcatccccatccagccatggccagtgaaggctgctgtgtgaagttgagaaaatcagcggtcctactggatgaagagaagatggacaccagccctcagcatgaggaaattcagggtcccctaccagatgagagagattgtgtacatgtgtgtgtgagcacatgtgtgcatgtgtgtgcacacgtgtgcatgtgtgtgttttagtgaatctgctctcccagctcacacactcccctgcctcccatggcttacacactaggatccagactccatggtttgacaccagcctgcgtttgcagcttctctgtcacttccatgactctatcctcataccaccactgctgcttcccacccagctgagaatgccccctcctccctgactcctctctgcccatgcaaattagctcacatctttcctcctgctgcaatccatcccttcctcccattggcctctccttgccaaatctaaatactttatatagggatggcagagagttcccatctcatctgtcagccacagtcatttggtactggctacctggagccttatcttctgaagggttttaaagaatggccaattagctgagaagaattatctaatcaattagtgatgtctgccatggatgcagtagaggaaagtggtggtacaagtgccatgattgattagcaatgtctgcactggatatggaaaaaagaaggtgcttgcaggtttacagtgtatatgtgggctattgaagagccctctgagctcggttgctagcaggagagcatgcccatattggcttactttgtctgccacagacacagacagagggagttgggacatgcatgctatggggaccctcttgttggacacctaattggatgcctcttcatgagaggcctccttttcttcaccttttatgctgcactcctcccctagtttacacatcttgatgctgtggctcagtttgccttcctgaatttttattgggtccctgttttctctcctaacatgctgagattctgcatccccacagcctaaactgagccagtggccaaacaaccgtgctcagcctgtttctctctgccctctagagcaaggcccaccaggtccatccaggaggctctcctgacctcaagtccaacaacagtgtccacactagtcaaggttcagcccagaaaacagaaagcactctaggaatcttaggcagaaagggattttatctaaatcactggaaaggctggaggagcagaaggcagaggccaccactggactattggtttcaatattagaccactgtagccgaatcagaggccagagagcagccactgctactgctaatgccaccactacccctgccatcactgccccacatggacaaaactggagtcgagacctaggttagattcctgcaaccacaaacatccatcagggatggccagctgccagagctgcgggaagacggatcccacctccctttcttagcagaatctaaattacagccagacctctggctgcagaggagtctgagacatgtatgattgaatgggtgccaagtgccagggggcggagtccccagcagatgcatcctggccatctgttgcgtggatgagggagtgggtctatctcagaggaaggaacaggaaacaaagaaaggaagccactgaacatcccttctctgctccacaggagtgtcttagacagcctgactctccacaaaccactgttaaaacttacctgctaggaatgctagattgaatgggatgggaagagccttccctcattattgtcattcttggagagaggtgagcaaccaagggaagctcctctgattcacctagaacctgttctctgccgtctttggctcagcctacagagactagagtaggtgaagggacagaggacagggcttctaatacctgtgccatattgacagcctccatccctgtcccccatcttggtgctgaaccaacgctaagggcaccttcttagactcacctcatcgatactgcctggtaatccaaagctagaactctcaggaccccaaactccacctcttggattggccctggctgctgccacacacatatccaagagctcagggccagttctggtgggcagcagagacctgctctgccaagttgtccagcagcagagtggccctggcctgggcatcacaagccagtgatgctcctgggaagaccaggtggcaggtcgcagttgggtaccttccattcccaccacacagactctgggcctccccgcaaaatggctccagaattagagtaattatgagatggtgggaaccagagcaactcaggtgcatgatacaaggagaggttgtcatctgggtagggcagagaggagggcttgctcatctgaacaggggtgtatttcattccaggccctcagtctttggcaatggccaccctggtgttggcatattggccccactgtaacttttgggggcttcccggtctagccacaccctcggatggaaagacttgactgcataaagatgtcagttctccctgagttgattgataggcttaatggtcaccctaaaaacacccacatatgcttttcgatggaaccagataagttgacgctaaagttcttatggaaaaatacacacgcaatagctaggaaaacacagggaaagaagagttctgagcagggcctagtcttagccaatattaaaacatactatgaagcctctgatacttaaacagcatggcgctggtacgtaaatagaccaatgcagttaggtggctctttccaagactctggggaaaaaagtagtaaaaagctaaatgcaatcaatcagcaattgaaagctaagtgagagagccagagggcctccttggtggtaaaagagggttgcatttcttgcagccagaaggcagagaaagtgaagaccaagtccagaactgaatcctaagaaatgcaggactgcaaagaaattggtgtgtgtgtgtgtgtgtgtgtgtgtgtgtgtttaatttttaaaaagtttttattcggaatccgcg

SEQ ID NO: 8890 - DNA, 1008 bp, Homo sapiens
gcaattctagccttggtacaaattcgatgaaaattatgcattcctgcaccgcacgctaaaggagattctcagatacctgatggatccagacacattcactttcaactttaataatgaccctttggtccttcgacggcgccagacctacttgtgctatgaggtggagcgcctggacaatggctggatggtcctgatggaccagcacatgggctttctatgcaacgaggctaagaatcttctctgtggcttttacggccgccatgcggactggcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgccgatcttcgctgcccgcatctatgattatgaccccctatataaggaggcgctgcaaatgctgcgggatgctggggcccaagtctccatcatgacctacgatgagtttgagtactgctgggacacctttgtgtaccgccagggatgtcccttccagccctgggatggactagaggagcacagccaagccctgagtgggaggctgcgggccattctccagaatcagggaaactgaaggatgggcctcagtctctaaggaaggcagagacctgggttgagcagcagaataaaagatcttcttccaagaaatgcaaacgagccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacactaaaaaaaaaaaaaaaaaaaaaaa

SEQ ID NO: 8891 - DNA, 1789 bp, Homo sapiens
agagtgaaggccaagaagcccatccagactaagttccgaatgccactcttgaactgggtggcattgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaagaaaaaaaaa

SEQ ID NO: 8892 - DNA, 2287 bp, Homo sapiens
ggctgaggcagtggctccttgcacagcagctgcacgcgccgtggctccggatcttcttcgtctttgcagcgtagcccgagtcggtcagcgccagaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagaacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgccccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgccgc

SEQ ID NO: 8893 - DNA, 1577 bp, Homo sapiens
ggcacgaggctgctgtttgtctacttcctcctgcttccccgccgccgccgccgccatcatgagggaaatcgtgcacttgcaggccgggcagtgcggcaaccaaatcggcgccaagttttgggaggtgatcagcgatgagcacggcatcgaccccacgggcacctaccacggggacagcgacctgcagctggaacgcatcaacgtgtactacaatgaggccaccggcggcaagtacgtgccccgcgccgtgctcgtggatctggagcccggcaccatggactccgtgcgctcggggcccttcgggcagatcttccggccggacaacttcgttttcggtcagagtggtgctgggaacaactgggccaaggggcactacacagaaggcgcggagctggtggactcggtgctggatgttgtgagaaaggaggctgagagctgtgactgcctgcagggtttccagctgacccactccctgggtggggggactgggtctgggatgggtaccctcctcatcagcaagatccgggaggagtacccagacaggatcatgaacacgtttagtgtggtgccttcgcccaaagtgtcagacacagtggtggagccctacaacgccaccctctcagtccaccagctcgtagaaaacacagacgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgtgttcaggggccgcatgtccatgaaggaggtggatgagcaaatgcttaatgtccaaaacaaaaacagcagctattttgttgagtggatccccaacaatgtgaaaacggctgtctgtgacatcccacctcgggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggtgtccgagtaccagcagtaccaggatgccacagccgaggaggagggcgagttcgaggaggaggctgaggaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaaaaaaaaaaaaaaaaaaaaaaaaaaa

SEQ ID NO: 8894 - DNA, 20 bp, Artificial Sequence
  Primer
gaagagcctggtcctggtga

SEQ ID NO: 8895 - DNA, 20 bp, Artificial Sequence
  Primer
tgacgacatcgagtgcttcc

SEQ ID NO: 8896 - DNA, 20 bp, Artificial Sequence
  Primer
agaggctgaggctgctgcta

SEQ ID NO: 8897 - DNA, 20 bp, Artificial Sequence
  Primer
cagctctaggtgggctgctc

SEQ ID NO: 8898 - DNA, 20 bp, Artificial Sequence
  Primer
gcccaagggtgaaaactgtg

SEQ ID NO: 8899 - DNA, 20 bp, Artificial Sequence
  Primer
tgggtctgctgctgtctgtc

SEQ ID NO: 8900 - DNA, 20 bp, Artificial Sequence
  Primer
tccgtcgttgacttgtgtcc

SEQ ID NO: 8901 - DNA, 20 bp, Artificial Sequence
  Primer
aggacggggatggacgtatc

SEQ ID NO: 8902 - DNA, 20 bp, Artificial Sequence
  Primer
tacattccccagagccaagg

SEQ ID NO: 8903 - DNA, 20 bp, Artificial Sequence
  Primer
gcctgcttgcaggaaatgaa

SEQ ID NO: 8904 - DNA, 20 bp, Artificial Sequence
  Primer
gcctgcaaggtgacctgtct

SEQ ID NO: 8905 - DNA, 20 bp, Artificial Sequence
  Primer
ctcccacccatatgctccac

SEQ ID NO: 8906 - DNA, 20 bp, Artificial Sequence
  Primer
tacattccccagagccaagg

SEQ ID NO: 8907 - DNA, 20 bp, Artificial Sequence
  Primer
gcctgcttgcaggaaatgaa

SEQ ID NO: 8908 - DNA, 20 bp, Artificial Sequence
  Primer
gcctgcaaggtgacctgtct

SEQ ID NO: 8909 - DNA, 20 bp, Artificial Sequence
  Primer
ctcccacccatatgctccac

SEQ ID NO: 8910 - DNA, 28 bp, Artificial Sequence
  Primer
ccgtaatcttaaagagaaaatctttgga

SEQ ID NO: 8911 - DNA, 28 bp, Artificial Sequence
  Primer
cccgtaatcttaaagagaaaatctttgg

SEQ ID NO: 8912 - DNA, 26 bp, Artificial Sequence
  Primer
tcactcagaaatggaacttttacctg

SEQ ID NO: 8913 - DNA, 27 bp, Artificial Sequence
  Primer
tcactcagaaatggaacttttacctgt

SEQ ID NO: 8914 - DNA, 22 bp, Artificial Sequence
  Primer
tggattccaggtctggagtttt

SEQ ID NO: 8915 - DNA, 20 bp, Artificial Sequence
  Primer
cacgtgcccatctcaagaca

SEQ ID NO: 8916 - DNA, 20 bp, Artificial Sequence
  Primer
cgacggtagtgaccagcaag

SEQ ID NO: 8917 - DNA, 23 bp, Artificial Sequence
  Primer
atgtgtgtgtgccagttctgttt

SEQ ID NO: 8918 - DNA, 24 bp, Artificial Sequence
  Primer
gcctctcaactgagcagtaaaggt

SEQ ID NO: 8919 - DNA, 26 bp, Artificial Sequence
  Primer
gcagtaaaggtaaggagagctcaatc

SEQ ID NO: 8920 - DNA, 21 bp, Artificial Sequence
  Primer
tgaagtctcaagtgggcatga

SEQ ID NO: 8921 - DNA, 21 bp, Artificial Sequence
  Primer
tgaagtctcaagtgggcatga

SEQ ID NO: 8922 - DNA, 20 bp, Artificial Sequence
  Primer
aacccactccccaggctaga

SEQ ID NO: 8923 - DNA, 20 bp, Artificial Sequence
  Primer
gccgcctgttcaagttcaag

SEQ ID NO: 8924 - DNA, 20 bp, Artificial Sequence
  Primer
atccagaccccgagtccttc

SEQ ID NO: 8925 - DNA, 20 bp, Artificial Sequence
  Primer
cacattggtgtgctgtgtgg

SEQ ID NO: 8926 - DNA, 20 bp, Artificial Sequence
  Primer
atggcagccttgcctaatcc

SEQ ID NO: 8927 - DNA, 21 bp, Artificial Sequence
  Primer
tgcatgagagagccactacca

SEQ ID NO: 8928 - DNA, 20 bp, Artificial Sequence
  Primer
tatgcagcagcccagtttca

SEQ ID NO: 8929 - DNA, 20 bp, Artificial Sequence
  Primer
aggtaggccaatcccagagg

SEQ ID NO: 8930 - DNA, 20 bp, Artificial Sequence
  Primer
acctctgtgccttgctgctc

SEQ ID NO: 8931 - DNA, 20 bp, Artificial Sequence
  Primer
atcccaaggaactggctgtg

SEQ ID NO: 8932 - DNA, 20 bp, Artificial Sequence
  Primer
atcaggctgctttggctacg

SEQ ID NO: 8933 - DNA, 20 bp, Artificial Sequence
  Primer
gcctcttcagggacagagca

SEQ ID NO: 8934 - DNA, 20 bp, Artificial Sequence
  Primer
aaggattgatcgccgttttg

SEQ ID NO: 8935 - DNA, 20 bp, Artificial Sequence
  Primer
ctgaaccatccaggccaaat

SEQ ID NO: 8936 - DNA, 20 bp, Artificial Sequence
  Primer
tgggcctgacaagaaccatt

SEQ ID NO: 8937 - DNA, 20 bp, Artificial Sequence
  Primer
acggcgatcaatcctttcct

SEQ ID NO: 8938 - DNA, 21 bp, Artificial Sequence
  Primer
tggcatgttttgtgcatttgt

SEQ ID NO: 8939 - DNA, 21 bp, Artificial Sequence
  Primer
aagccaaagtggcatgttttg

SEQ ID NO: 8940 - DNA, 23 bp, Artificial Sequence
  Primer
cttggctcagtatgcaacctttt

SEQ ID NO: 8941 - DNA, 24 bp, Artificial Sequence
  Primer
ggctcagtatgcaaccttttaagc

SEQ ID NO: 8942 - DNA, 20 bp, Artificial Sequence
  Primer
gccgaggactttgattgcac

SEQ ID NO: 8943 - DNA, 20 bp, Artificial Sequence
  Primer
gaacggtgaaggtgacagca

SEQ ID NO: 8944 - DNA, 21 bp, Artificial Sequence
  Primer
gaagtggggtggcttttagga

SEQ ID NO: 8945 - DNA, 20 bp, Artificial Sequence
  Primer
aatcaaagtcctcggccaca

SEQ ID NO: 8946 - DNA, 19 bp, Artificial Sequence
  Primer
tccacaccatgggcagaac

SEQ ID NO: 8947 - DNA, 20 bp, Artificial Sequence
  Primer
cagggcctgggtttgaataa

SEQ ID NO: 8948 - DNA, 21 bp, Artificial Sequence
  Primer
ggccctgcaattattcaaacc

SEQ ID NO: 8949 - DNA, 21 bp, Artificial Sequence
  Primer
ttgattgctgaatgggagagg

SEQ ID NO: 8950 - DNA, 20 bp, Artificial Sequence
  Primer
cccttggtgtctggaagcac

SEQ ID NO: 8951 - DNA, 20 bp, Artificial Sequence
  Primer
ttaggtagctgggcggctta

SEQ ID NO: 8952 - DNA, 20 bp, Artificial Sequence
  Primer
gtctgtgccttggggttgtc

SEQ ID NO: 8953 - DNA, 20 bp, Artificial Sequence
  Primer
ggtgcttccagacaccaagg

SEQ ID NO: 8954 - DNA, 20 bp, Artificial Sequence
  Primer
aggaagcagggttggtttcc

SEQ ID NO: 8955 - DNA, 20 bp, Artificial Sequence
  Primer
cccagagccaatcagtagcc

SEQ ID NO: 8956 - DNA, 20 bp, Artificial Sequence
  Primer
ccaagatggcagtcggaact

SEQ ID NO: 8957 - DNA, 20 bp, Artificial Sequence
  Primer
tgttccccaggattccaaga

SEQ ID NO: 8958 - DNA, 20 bp, Artificial Sequence
  Primer
ggctgcccagaaagcagtta

SEQ ID NO: 8959 - DNA, 20 bp, Artificial Sequence
  Primer
aaagaggctgcccagaaagc

SEQ ID NO: 8960 - DNA, 23 bp, Artificial Sequence
  Primer
ttcttcggtgaagcacaagtttc

SEQ ID NO: 8961 - DNA, 24 bp, Artificial Sequence
  Primer
tgaagcacaagtttcttttcatgg

SEQ ID NO: 8962 - DNA, 20 bp, Artificial Sequence
  Primer
aagtgagcggtgctgtcctc

SEQ ID NO: 8963 - DNA, 20 bp, Artificial Sequence
  Primer
agcggtcagcagacaaggag

SEQ ID NO: 8964 - DNA, 20 bp, Artificial Sequence
  Primer
tggggcactcctaggttcag

SEQ ID NO: 8965 - DNA, 20 bp, Artificial Sequence
  Primer
aatgcttccacagggtcagg

SEQ ID NO: 8966 - DNA, 20 bp, Artificial Sequence
  Primer
tggcctctgcctgttttcat

SEQ ID NO: 8967 - DNA, 20 bp, Artificial Sequence
  Primer
aggaccagggcgttataggc

SEQ ID NO: 8968 - DNA, 20 bp, Artificial Sequence
  Primer
cgtcatggcaagtgtgtcaa

SEQ ID NO: 8969 - DNA, 20 bp, Artificial Sequence
  Primer
atgccacacaaccaaagtgg

SEQ ID NO: 8970 - DNA, 20 bp, Artificial Sequence
  Primer
gggtccctgctgctttctct

SEQ ID NO: 8971 - DNA, 20 bp, Artificial Sequence
  Primer
ggcgtccatcttcacactga

SEQ ID NO: 8972 - DNA, 20 bp, Artificial Sequence
  Primer
tccaacttggggaaggagtg

SEQ ID NO: 8973 - DNA, 20 bp, Artificial Sequence
  Primer
acccggaagagtcccaagac

SEQ ID NO: 8974 - DNA, 20 bp, Homo sapiens
agcatccccacctcaggatt

SEQ ID NO: 8975 - DNA, 20 bp, Artificial Sequence
  Primer
ttacggtgagccctttcagg

SEQ ID NO: 8976 - DNA, 20 bp, Artificial Sequence
  Primer
gtgtctgggtttgggtcctg

SEQ ID NO: 8977 - DNA, 20 bp, Artificial Sequence
  Primer
gcatgtctcgcacaaaccat

SEQ ID NO: 8978 - DNA, 20 bp, Artificial Sequence
  Primer
ccaagtgccttcatgcccta

SEQ ID NO: 8979 - DNA, 21 bp, Artificial Sequence
  Primer
tctgccttcagagcttcgaga

SEQ ID NO: 8980 - DNA, 20 bp, Artificial Sequence
  Primer
cggcagattcagatcgaggt

SEQ ID NO: 8981 - DNA, 20 bp, Artificial Sequence
  Primer
cagcccagaaggctttggta

SEQ ID NO: 8982 - DNA, 20 bp, Artificial Sequence
  Primer
ctggcaggactgcaacaaga

SEQ ID NO: 8983 - DNA, 20 bp, Artificial Sequence
  Primer
gctccctcagcgactacagc

SEQ ID NO: 8984 - DNA, 20 bp, Artificial Sequence
  Primer
cagatggggcagctgaactt

SEQ ID NO: 8985 - DNA, 20 bp, Artificial Sequence
  Primer
aggaaaggccagggactcac

SEQ ID NO: 8986 - DNA, 20 bp, Artificial Sequence
  Primer
tccctccatcatcgacactg

SEQ ID NO: 8987 - DNA, 25 bp, Artificial Sequence
  Primer
gtctagcctcagagtaacccctgtt

SEQ ID NO: 8988 - DNA, 22 bp, Artificial Sequence
  Primer
ttggcataaaataagcgacgaa

SEQ ID NO: 8989 - DNA, 22 bp, Artificial Sequence
  Primer
ttggcataaaataagcgacgaa

SEQ ID NO: 8990 - DNA, 20 bp, Artificial Sequence
  Primer
ctgctgacccaccaaggtct

SEQ ID NO: 8991 - DNA, 20 bp, Artificial Sequence
  Primer
gagcaggggtggtttctacg

SEQ ID NO: 8992 - DNA, 20 bp, Artificial Sequence
  Primer
cccgcagctctgagtaagga

SEQ ID NO: 8993 - DNA, 20 bp, Artificial Sequence
  Primer
tccttcccctagcagcttcc

SEQ ID NO: 8994 - DNA, 21 bp, Artificial Sequence
  Primer
tggttgccttaaggtgtttgc

SEQ ID NO: 8995 - DNA, 20 bp, Artificial Sequence
  Primer
acattaaatccgccctgcaa

SEQ ID NO: 8996 - DNA, 21 bp, Artificial Sequence
  Primer
gccacagtatgcttcccattg

SEQ ID NO: 8997 - DNA, 23 bp, Artificial Sequence
  Primer
tgctctaatcaagtgggaagcag

SEQ ID NO: 8998 - DNA, 20 bp, Artificial Sequence
  Primer
ttgacttccgcaaggacctc

SEQ ID NO: 8999 - DNA, 20 bp, Artificial Sequence
  Primer
gcctttcctgcttctcatgg

SEQ ID NO: 9000 - DNA, 20 bp, Artificial Sequence
  Primer
tccaggctccaaatgtaggg

SEQ ID NO: 9001 - DNA, 20 bp, Artificial Sequence
  Primer
ctccgtggagctgaagcaat

SEQ ID NO: 9002 - DNA, 21 bp, Artificial Sequence
  Primer
tccacctcgacgtttacaagc

SEQ ID NO: 9003 - DNA, 19 bp, Artificial Sequence
  Primer
cctgcccctttacggacac

SEQ ID NO: 9004 - DNA, 20 bp, Artificial Sequence
  Primer
ccctcttcccctccctgtta

SEQ ID NO: 9005 - DNA, 18 bp, Artificial Sequence
  Primer
gccggagtccagtgtggt

SEQ ID NO: 9006 - DNA, 20 bp, Artificial Sequence
  Primer
accctcctgtccaacatcca

SEQ ID NO: 9007 - DNA, 20 bp, Artificial Sequence
  Primer
tgttaacaacacgcccctca

SEQ ID NO: 9008 - DNA, 20 bp, Artificial Sequence
  Primer
cagcattgcggaacactgag

SEQ ID NO: 9009 - DNA, 20 bp, Artificial Sequence
  Primer
tgtccatctctgcaccttgg

SEQ ID NO: 9010 - DNA, 21 bp, Artificial Sequence
  Primer
ttttgatgtcagagcccaagc

SEQ ID NO: 9011 - DNA, 20 bp, Artificial Sequence
  Primer
tcagtgtggcatcctgcttc

SEQ ID NO: 9012 - DNA, 20 bp, Artificial Sequence
  Primer
gaagcaggatgccacactga

SEQ ID NO: 9013 - DNA, 20 bp, Artificial Sequence
  Primer
tgaagctaaccaccggcatt

SEQ ID NO: 9014 - DNA, 21 bp, Artificial Sequence
  Primer
tggcatgttgttggagattga

SEQ ID NO: 9015 - DNA, 20 bp, Artificial Sequence
  Primer
ggctgcccagaaagcagtta

SEQ ID NO: 9016 - DNA, 20 bp, Artificial Sequence
  Primer
tgggcagcctctttagcttg

SEQ ID NO: 9017 - DNA, 23 bp, Artificial Sequence
  Primer
ttcttcggtgaagcacaagtttc

SEQ ID NO: 9018 - DNA, 20 bp, Artificial Sequence
  Primer
aaacccttttgcgtggtcct

SEQ ID NO: 9019 - DNA, 24 bp, Artificial Sequence
  Primer
ttaatatgtgggaaacccttttgc

SEQ ID NO: 9020 - DNA, 23 bp, Artificial Sequence
  Primer
cctgttaatggtgtccactttgg

SEQ ID NO: 9021 - DNA, 23 bp, Artificial Sequence
  Primer
cctgttaatggtgtccactttgg

SEQ ID NO: 9022 - DNA, 20 bp, Artificial Sequence
  Primer
acatcatcgcatggcatcag

SEQ ID NO: 9023 - DNA, 20 bp, Artificial Sequence
  Primer
acaacaaggggagcggagtt

SEQ ID NO: 9024 - DNA, 20 bp, Artificial Sequence
  Primer
aactccgctccccttgttgt

SEQ ID NO: 9025 - DNA, 21 bp, Artificial Sequence
  Primer
tcagcctcatcctcaaactgg

SEQ ID NO: 9026 - DNA, 20 bp, Artificial Sequence
  Primer
cagctccaaggggaatcaga

SEQ ID NO: 9027 - DNA, 20 bp, Artificial Sequence
  Primer
agccaggaatttcccaggac

SEQ ID NO: 9028 - DNA, 20 bp, Artificial Sequence
  Primer
ctggatctgcctggattggt

SEQ ID NO: 9029 - DNA, 20 bp, Artificial Sequence
  Primer
acagtgggctcccctttctc

SEQ ID NO: 9030 - DNA, 20 bp, Artificial Sequence
  Primer
ggcagcaactccgagagaaa

SEQ ID NO: 9031 - DNA, 22 bp, Artificial Sequence
  Primer
tgcagtgtggacattcaacaga

SEQ ID NO: 9032 - DNA, 20 bp, Artificial Sequence
  Primer
gcaggctggattctttggtg

SEQ ID NO: 9033 - DNA, 20 bp, Artificial Sequence
  Primer
tctcggagttgctgccaata

SEQ ID NO: 9034 - DNA, 20 bp, Artificial Sequence
  Primer
ctcacaggagccacagctca

SEQ ID NO: 9035 - DNA, 20 bp, Artificial Sequence
  Primer
ccacggtatcctgtggttcc

SEQ ID NO: 9036 - DNA, 20 bp, Artificial Sequence
  Primer
cacccataagccccaacaga

SEQ ID NO: 9037 - DNA, 20 bp, Artificial Sequence
  Primer
tgattgaggagcttggcaga

SEQ ID NO: 9038 - DNA, 20 bp, Artificial Sequence
  Primer
atgctgcccttcttttgcac

SEQ ID NO: 9039 - DNA, 20 bp, Artificial Sequence
  Primer
ggcaagcttgggaatgaatg

SEQ ID NO: 9040 - DNA, 20 bp, Artificial Sequence
  Primer
ggagcctctggtggctcata

SEQ ID NO: 9041 - DNA, 20 bp, Artificial Sequence
  Primer
tgctggaggtaatcgccact

SEQ ID NO: 9042 - DNA, 21 bp, Artificial Sequence
  Primer
tcgacatggtgaggtagagca

SEQ ID NO: 9043 - DNA, 22 bp, Artificial Sequence
  Primer
tttggtgacagtgagcttgagg

SEQ ID NO: 9044 - DNA, 20 bp, Artificial Sequence
  Primer
tgttctggcagcacctcaag

SEQ ID NO: 9045 - DNA, 21 bp, Artificial Sequence
  Primer
tggatggccgtttagagagaa

SEQ ID NO: 9046 - DNA, 20 bp, Artificial Sequence
  Primer
ggcttaacccaggcatcctc

SEQ ID NO: 9047 - DNA, 20 bp, Artificial Sequence
  Primer
tgtctggaagccacaactgg

SEQ ID NO: 9048 - DNA, 20 bp, Artificial Sequence
  Primer
gaggcctgcttccagttgtg

SEQ ID NO: 9049 - DNA, 20 bp, Artificial Sequence
  Primer
gggttttctgtggccctctt

SEQ ID NO: 9050 - DNA, 20 bp, Artificial Sequence
  Primer
cccacttccccatgtttgtc

SEQ ID NO: 9051 - DNA, 20 bp, Artificial Sequence
  Primer
taaaacagcccagcgctcac

SEQ ID NO: 9052 - DNA, 20 bp, Artificial Sequence
  Primer
cggcagatccctgaaatgac

SEQ ID NO: 9053 - DNA, 20 bp, Artificial Sequence
  Primer
gctggaaacctggcagtgat

SEQ ID NO: 9054 - DNA, 19 bp, Artificial Sequence
  Primer
ccatggggtcttgccctac

SEQ ID NO: 9055 - DNA, 20 bp, Artificial Sequence
  Primer
tgctccttctcgccatcaat

SEQ ID NO: 9056 - DNA, 20 bp, Artificial Sequence
  Primer
aggctggaccatcagtcagg

SEQ ID NO: 9057 - DNA, 20 bp, Artificial Sequence
  Primer
aggaagcagccaggaagatg

SEQ ID NO: 9058 - DNA, 20 bp, Artificial Sequence
  Primer
aaactcggcatgtcctccag

SEQ ID NO: 9059 - DNA, 20 bp, Artificial Sequence
  Primer
cggtcagatcgttgcgtaga

SEQ ID NO: 9060 - DNA, 20 bp, Artificial Sequence
  Primer
caaggatgaggacggtgctt

SEQ ID NO: 9061 - DNA, 20 bp, Artificial Sequence
  Primer
tgggcttagccttgatccac

SEQ ID NO: 9062 - DNA, 20 bp, Artificial Sequence
  Primer
tggggctgggagtagttgtc

SEQ ID NO: 9063 - DNA, 20 bp, Artificial Sequence
  Primer
catccctccccagttcattg

SEQ ID NO: 9064 - DNA, 20 bp, Artificial Sequence
  Primer
ggaaggtgtttggggtcaga

SEQ ID NO: 9065 - DNA, 19 bp, Artificial Sequence
  Primer
gtggcatgccctgtccata

SEQ ID NO: 9066 - DNA, 20 bp, Artificial Sequence
  Primer
tcttggagattcgagcagca

SEQ ID NO: 9067 - DNA, 20 bp, Artificial Sequence
  Primer
aggcagcagtgcaagtgaca

SEQ ID NO: 9068 - DNA, 20 bp, Artificial Sequence
  Primer
ctgcgaccagagtcagtgga

SEQ ID NO: 9069 - DNA, 20 bp, Artificial Sequence
  Primer
tggctattgctggcctccta

SEQ ID NO: 9070 - DNA, 20 bp, Artificial Sequence
  Primer
ctctgccaagttgtccagca

SEQ ID NO: 9071 - DNA, 20 bp, Artificial Sequence
  Primer
ggaccccaaactccacctct

SEQ ID NO: 9072 - DNA, 20 bp, Artificial Sequence
  Primer
aggtacccaactgcgacctg

SEQ ID NO: 9073 - DNA, 20 bp, Artificial Sequence
  Primer
tggacaacttggcagagcag

SEQ ID NO: 9074 - DNA, 20 bp, Artificial Sequence
  Primer
cctgggttgagcagcagaat

SEQ ID NO: 9075 - DNA, 20 bp, Artificial Sequence
  Primer
cagccctgggatggactaga

SEQ ID NO: 9076 - DNA, 20 bp, Artificial Sequence
  Primer
agcacattgctttgctggtg

SEQ ID NO: 9077 - DNA, 20 bp, Artificial Sequence
  Primer
aggcccatccttcagtttcc

SEQ ID NO: 9078 - DNA, 20 bp, Artificial Sequence
  Primer
caggctgaggctcaaggaag

SEQ ID NO: 9079 - DNA, 20 bp, Artificial Sequence
  Primer
cctccgacctctcgctgtag

SEQ ID NO: 9080 - DNA, 20 bp, Artificial Sequence
  Primer
ccaagaggaggatgcaccag

SEQ ID NO: 9081 - DNA, 20 bp, Artificial Sequence
  Primer
gctgaggaccaccttccttg

SEQ ID NO: 9082 - DNA, 20 bp, Artificial Sequence
  Primer
ccctggcccttacttgcttc

SEQ ID NO: 9083 - DNA, 20 bp, Artificial Sequence
  Primer
gcaagagggtgacagcttcc

SEQ ID NO: 9084 - DNA, 20 bp, Artificial Sequence
  Primer
ggtggagggtggagtgtttg

SEQ ID NO: 9085 - DNA, 20 bp, Artificial Sequence
  Primer
gctgtttcttgaccccaagc

SEQ ID NO: 9086 - DNA, 327 bp, Homo sapiens
ggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctctcccagtgtaaatctggagccaagtccagatttacactgggagaggtgccagcaactgaataaatacctcttagctgagtgg

SEQ ID NO: 9087 - DNA, 20 bp, Artificial Sequence
  Primer
acgagcctgcaccaaagtct

SEQ ID NO: 9088 - DNA, 20 bp, Artificial Sequence
  Primer
aaacaatggcatgcctccac

SEQ ID NO: 9089 - DNA, 20 bp, Artificial Sequence
  Primer
tcattacagcgggggcttag

SEQ ID NO: 9090 - DNA, 20 bp, Artificial Sequence
  Primer
gggggcttagtttgcttcct

We claim:

1. A method of diagnosing or monitoring an autoimmune or chronic inflammatory disease in a patient, comprising detecting the expression level of a nucleic acid in said patient to diagnose or monitor said autoimmune or chronic inflammatory disease in said patient wherein said nucleic acid comprises the nucleotide sequence SEQ ID NO: 151.

2. The method of claim 1 wherein said autoimmune or chronic inflammatory disease is systemic lupus erythematosis (SLE).

3. The method of claim 1 wherein said expression level is detected by measuring the RNA level expressed by said nucleic acid.

4. The method of claim 3, further including isolating RNA from said patient prior to detecting said RNA level expressed by said nucleic acid.

5. The method of claim 3 wherein said RNA level is detected by PCR.

6. The method of claim 3 wherein said RNA level is detected by hybridization.

7. The method of claim 3 wherein said RNA level is detected by hybridization to an oligonucleotide.

8. The method of claim 7 wherein said oligonucleotide comprises DNA, RNA, cDNA, PNA, genomic DNA, or synthetic oligonucleotides.

* * * * *